United States Patent 10,233,495 (METHODS AND COMPOSITIONS FOR SCREENING AND TREATING DEVELOPMENTAL DISORDERS) - sequence listing, part 20

SEQ ID NO: 93 - DNA, 764770 bp, Homo sapiens
  misc_feature (374233)..(474232): n is a, c, g, or t
aggaaaagttgttgaggttataaaggatgaactctaggtatgttgaacattggtctgaagctattgtgtagtgattaagagagtaagctttgcagtcataatgacgtgggtacaaattccagctctgtctctcaatagcatgagaccttagagaaattaacttctaatctttagtatcttaataaatgggaatttagaaataatttccaaaggattgctataatgtttcaaatgatttttttaaaggcagttaagtgatcaataagctggagctattgttatttttattgtttctgtagttcaggaaagatggattgttctaacaattattgttggtgaacttaaccagaaaatgtagtattgagtgactcagatttttggcctagctatgggtggaaataactttctgggtaaagatgctgaactaaaaacttgcagccaaaaatcctcttcagacctcagggatcatcacaatataattgtaaaaatataacaatgaacatggaagtacagatatctcttttgagagcctgatttcaattgttttggatatatacacagaaatagaattgctggatcatatggtagttctatatttgaggaacttccatactcttttttttttttatatagtcgctgcaccgttttacattcctgctatggtgtataagtattccaatttctccgtatccttgccaaaacctggtatcttttgaaacaacttatacgtctgttgaaagatgaatgggttaaaaaacatatggtttatacattcaattgaatactattcagtcttaaaaaagaagaaaatcggccagtcacagtggcttatgcctgtaatctcggcactttgggaggccaaggcaagccgatcactagacgccaggagttggagatcagcttggcatacatggcgaaaccccatcactactaaaaatacaaaagttagcctggcatggtagctcgcacctgtaatcccagctactcaggaggctgacaggacaatcggttgagcctgggaggcagaggttgtagtgacccgagatcgcaccactgcactccagcctaggccgcagaggagagactgtgtctcaaataaaaataaaaataaaaataaaaaaaggaaatcttgctgtatgtaacaacatgaatgaccctggaggatgttctgctaagtgaaataaatcagtcggagaaggacaaatactgtactgcatgattccacttctatgaagtatctaaaatattcacattcacggaaacagtaagatggttgttgccagggactagggggaaagggaaatggggagttgctgttcaacaggtataaagttttatttctgcaagacaaataagttatagagagctgctgtacaatgttgtgcctgctgttaatgatactgtattctgcacttaacattttgttgagggtagatttcatgttcaaggttcttactgcaataaaattttttttaaaaaacctcaataattaccaaaaaattatttcaatatgtagtaaaaagaaatataatgcttctgaaggcagttccttttgtactgatgataacgaattgtgaattgagatgagtggaatttagcaataaaaagtgtcaagagcattgggcaatattgatgtcaattctacctaatttcatctatagatttggaacaatcccaatcaaaacctcagtgctttttaacagaaattcacaatattgagtttcttgttaattgaaatttacaaggaaaggtaatggatataggatatcgaaaacaattttggaaaacaacaacaattttggaggactagcattacctgatttcagggcttactacaaacttatggtatcaagatagtgtggtatttatgtaaagtaagacaaatacatcaatagatcagaacacagtgtccaaaagtagagtcacagatattatggtcaattgaatttgacaaaggtaccaacataattgaaatgtgtagaaggatagccttttcgacaaatagtgttgaggcaattagatatacatatggaaataaatgaccgtgacccctaccttacataatacacaaaaattaattcaaaatggatgataggtctaaatataaaagttgttttaaaacttctagaagaaaacatgggagaaaatttttaccaccttggagtaggaaaagatttctcatataaaataatcacaagtcctaacatttttaaaaattaatacaattgcagctcaaaaaattaaaatgttatggtctttaaaagatgctaaatgaataagtaagtgaataaggcacattacagactaggagaaaatagttacaaaacatttgtccaacaaaagactcgtaggatatatacagagagaggacttgctactcagtaaaaagacaaatatcccaatttgaaaaaatagacaaaagacttcatcatagaagatgtgttgaacaggcaattatcacatcattgtcatcatgaaatatcacttcaatcccactggaatggctaaaattaataagattggaaatagcaagtgtcgcacaggcatggtggctcacacctgtaatcctagcactttgggaggctgaggcgggaagattgtttgggcttggagtttgagaccagcctgggcaacatagtgagacatctctacaaaaaattttaaaaattagcagggcatggtagcacatgcctgtagtcccagctatttgggaggctgaagtgggaagaactcttgagcctggggaggagagggctgcagtgagccctgattacaccactgcactccatcctgggtgacagagtaagaccctgtgtcaataaataaataaatacataataaaaaatgaaaatagcaaatgttggcaaggatctgaagcaattagagcatttatactttgctagtaggaatataaaatagtacaaccactttggaaaacagtagtaattatttattatgaatctaaacaagtacttatcataggacccaatatttcccctcctaacaaaaacaaattgtgtcatatttatcagtcaaaatactgctcagcaataaaacaaaaactacacatgacaacatggatgaatctcacatatatgctgagtgaaagatgctggacacaatatggttgagatgacactagtcattaagaaataaatcacatttgtggttcccaggtgcaagaatgttggggaagtttaatggcaaaggagcatgagaaaccttctagggagatggaaatgctctatatcttgattgttgtggtggttacgtggatgaatacaaagactctctccttgaccaaacttagtcaggctcctctgataccttttgtcaactagaccttgaccttaggcttccatgtctttatttgttcagttttagctagactcctgctaagtcactttagtaagagtcccttgcttttggtatctggtcaccttcaaaatctgatcaaattcattattctctaccttcccccagatgatatctgatcaccctaacctgcctttagaaagaatactatcaaatcagtttagcaagaatctcctcttaccccttgctatgatttggatgtttgtcccctccaaaatcatgttgaaatttaattgccattgtaacagtattaagaagtgagacccttaagaggtgattaggcaataaaggctccaccctcataagtgggactgatattataaaaaggagacttcaaccctctgttggcctttttgccttccaccatggaatgatgctgcaagaaggctcttaccagatgtcagcaccttgacattgaacttctcagctttctgaactatgaaccaataaatttctgttcattataaatgacccagtctcttgggccaggcatggtggctcacgcctgtaatcccagcactttgggaggccaaggtgggtggatcacttgagatcaggagttcaagaccagccttatcaacatggagaaaccccgtctctactaaaaatacaaaattagccaagcgtggtggttcatgcctgtaatcccagctactcaggaggctgagacaggagaatcgcttgaacccgggaagcggagatttcagtgagccgagattgcgccattgcactccagcctgggcatacagagcaagactccgtctcaaaaaaaaataaataaataaataaataaataaataaattacccagtctcaggtattctgttacagcagcacaaaatggacaaagacacccctaatgtttcctcttagtaattttcaatccactgacccccaaccctgttcatttgctataaatctccccttgttcatgctgtattcagaattgagcccaattccatactgaggtttattttcctacattgcaatatttactaaataaaatttgttttttctgctctagctactattcaactgtgattttctttaacagtgtaatgcagcagagtcatttgtgttgtgccaagttcctgcctgtgaaatttagcatatgttgtagttttaaaataactaacattttaccaatacatttacttataacttctttttgacatatattatcttatttaacattctgaaacagcttgtgatttaattacaataacaccaattatatttttaattgaaaaataaataaaaggaatatttaaatatcactgggtattcttaaatttggaaatgtattaatcttcagatttaagaccaggtacctaagccttttcttccacagtaggatgtcaatgttaaattttcatttagcttttacatgtaccacagaatgcagccttgaatcctttaatagcaattatattggtttattgagtttcataacaggaaatagactatcaaaatataagtacttccaaaaaaagataacattttacaaggcccttttttggaaaacatggttaattattcctgagatatttatagaattctggaattctgaagttgttctgcttacttttgagtaatatcggtagctgacattttctgagtactgactgtgcccaatctgctctgtgtgctgcctatattttacctcacttaattcttatcacagtcttataagggattttttttttttttttgagacagagtatgccctatgtggcccaggctggagtgcagtggtgcgatcttggctcactgcaacctctgtttcctgggttcaagcgattctccttcctcagcctcccgagtagctaggactataggcaagcaccaccatgcctggctaatttttgtatttttagtaaagatgggtttttgccatgttggccaggctggtctcgaactcctgacctcaagtgatctgcccacctcagcctcccaaagtgctggaattacaggcatgagccacagcgcctgacttgttatctttattaggaacaaagtttcttctgagtaaacatttagtctttttgttgttgttgttgttgttgttgttgagacagggtctcgctctgttgtctaggctggagtgcagtggcatgatatcggctcactacaatctcctcctcctgggttcaagcattcttctgcctcatcctcccaagtagctgagattacaggtgcgcggcaccatgcctggctaattttttgttgttttagtagagatggggtttcactatgttggccaggctggtctcaaactcctggccttaagtgatccgcctacctcggcctcccaaggtggtgggattacagttgtgagccatcacgccggcttcttggtggcatcttgatacagggtgtgctggatatctgtggccaccctgatcaattttccaccttgctctattccttaagaatctcattcatagggactacacaataatcgtttatcttctctcagttttggttgagttcaggcatttgaagataggaagaaagtaagggttttgaactatttattttcatggctccctctatgtagggttaacatagggtagctctgtctctctatctatgacctcaattccttttcaaccctatctatacatctattctatctgggctctagtaactctgccttccacttgcccatccaggcccagggtagtgctatggaatgaactcccatccacccccaaattcatatgttgaagccctattccccaatatgactatattcgaaaataagaccttaaggaggttattaaacttaaatgagttcataagggtgtggtcctgatccagttgggttaatgtacttattaaaagagacaccagagagcttgctttctcttctcattcaggcaccaaggaagggccatgtgaggacaaagcagctgtctgtaagccaggaagggagccctcaccagatattgtaccctgttagaacgaaccttgatcttggactgtccagtctctaaaactgtaagaaaattaacttctgttgtttaagccatccagtctgtggtattttgttatggaagcccaggctgactaattgggatagtaaggcactatcttgtatagtttcttaacactctgcccgcacttttgtaaagagtccctttattaaactccccctaattggcattcatgctgttttctgataggatcctgattcatacaaagcagacaatcagagaacattacccaagctaagaagagtgactgacccaaatgttctccttctctcctggaacttgaaggcataataagagtgcatcttatttctcttggtagttaggcttcagtttctgtttctgttttgaagtgtatgagactgctgtaactcatgctctgttcttttggcccagccaatgtatggcagtttcttataaggatcacaacccaccatctcctcaggctgaccagattcttcacttcagctcttgctggtactgtggatttttcaagactcacttatgtgcatactccatttgaccctagcactggcctttgcagtggtgactccttggagaaaaactcactcagtccatggttaacttgcacacacctccagagttacatgggcatttctagttctcttcacatcttgggaaaccaagagacaatctcctaggctccccctgcttaaacatgctacttaaccattttaactctactgtggccttcacattggctctaggcactctgcttccaaaattccaaacaggaagtggggtgcaaatcctatgtactttcacttaatgtctctgtagacattcagaagcacatttccacccaatttccctctgaccctcttcttggacaaagtttttgtgataaccactttgatgataaagaatctagtgaggccttaagatacaacctaagaaagaaggtcaaaaactgcaaagtagaaagaacatttagatttctacaacttttgcaatttcttgtgtatgtgacgtttgtctccttataccacagagattaccaaaacaggcaccagaggaaaaaaaagatgatcaccaccaccaccaccaccatttaataaataatgtgtttagcataacttcaggatgagaaaagaagattagagctggtgggacagtgattctaagacttctcagaggtgatttccaggatgactactccaaagagaagaggcaagtaaactgcagtcctcaggacctgttgctaagaagaaaagaaattctgaagaatcaattcagatctgaaaatattggactgggtcgaaacacacttgaaaatataatctgtcatacattttctcattgcttaggagtatgggcttgggcataaataagattagcattttagcaaacatttactgcttagaagctatgtgaacgtggagaagtgtaacacagaggtgaagagccctggctccagagttagggatgtggcttgaatcctcgctctgctacccagagcaaattatttacttctttgagcaaattatttacttctttgaacctcattttgttttctttaactaggatagctaatccaatagttttttcttcatcaagtcatatgtgaagtacttatcactaacctgttgtgtgtatgcatgttagtgctaagtacttcagcaattgatcatcattattatcaacctgagaaaactcactttactcttgtcaaaggaaaataaatctcaggacccaaaaatcactaagccaaagggaagtcaagctgggaactgcaatgggcacacctgcctcccattctattcctaaataagatagctacaaaaattaaaaagctacatgcttcccttgcagttttcccataaggaaattccttgtgaacaagagacggaactcagagtcatccctgtgctcacgtgagtcagagtccagcctgggcagcatagtgaggccctgtctcgacaaaaatttaaaaacttagctgagtgtgattgtgtggttggctcatgcctgtagttccaattacttgggaggctgaggtgggaggattgcttgagccaggttgctcaatgctgcagtgaggtatgacactgccactgcatgtcagcctggaagacagagtcagatcctatctctggaaaaaaaaaatgcttgtagaatgtaaacatgaggccctgtctctacaaaaagttgcttgggtgtggttgagcccaggagtttgaggttgcagtgagcaatgattgcaccattgcattccagcctggataacagagtaagatactgtttgaaacaggaaaaagaaacaaaaacaacatttgtatgtgggtatgttttatttccggggggctgctataacaaagtattatagattgtgtcttcatattttggaaggggaaaacaagctcattggggccgcttttttaagggcactaatcccatttatgagggctcttctgtcacgatccaatcaccatccaaaggcccaacctcttaataccaacaccttggggcttagaatttcaacaaacggattttggaggcaggggacataaatgttctgatagcagggctttttagaagtgtcatgaataattaaattctaatcatggtagccaagccatgtatcagctttcttataacttaattagaatgccaaatactgtggaagaaacaataacattgcaagcaaatgtgttattgttactttgaaggaagttatcttctagtatagtagaagtagtagatattgtagtggggtaaaacgtgttttctgacaatgactccttttaccagtagtgaactggtaaatgtttaacaaccagctctccagaaaaacaaaataaaacaaaacttatttgtaatgtttgtcaatttatgtggtgtaattactcctgccatgaccaatttcaaactatctatgtgacatctcatcactgaacacaggaagaaatgagaagtaacaaaattttatagtattttcaccatacaggtgcaataattgtaaatataaataacctcaagaacaaataatattaagttataattgaaagaatcaggaagtggtgaattttgaatatttattacttttgtatttaatatagtttacttaactatacttaatattattaactttgtataatttattttttaataatccctatgtttaacaaccagtctacaaaaattttaaaaatttaacaactggctcttataagtcattacaggcaagcttcagcacaccattatgcttaactgcccctcagatacacagcactcatagctatatatgtatgattttataggatatcctggccacagctgatgagagtaaatagggatgggaataggttcaatgtcacttctcccagaatttggaaagggaatcagactggaaatcatcctgtttgtgtggctgaaactataactcatgaaaatttgaagttacaggcagtcactttttgaccattatgtggacttagtagtaaataagatttatcttccagtatagaagcataaaaatatgcaaagggaaaccagaaatggggaaacacatctcatttgtcttaaagcattctagatttcagcggcagttcttgagacctggttgcattctacccttcgatttggacagatacatttaccctcacagtagttttccttttcctctaatataactcgaattgctttttgttatttgcaaacaaaaagatggacatgaaggaaaaaggaaatagcaaaatacgcaaaataataagcgtagtataatactgggtgaaaaatgttcaattgctctatagctcatagatcaaaatagagaactttgccctaactctattcgtagataatgaacattaggataaatatttcaactctcctttttgagaaaaccacaatctaaatacagctacctttctctgtagattctactgtaatgtgtgcttggatttaactgcctctcattgtaaacaagattgttttgaggcagctgaaaggtaaagagctttcctttggcaagctcaacaactcttgtgacttaatcatcatctatacaagaatgattacttcagtcagacttctcacctgatgtcagttgtttccttgacatcttttcttagatgtctcatgattagctcaattttaaaaagctcaacagtacccccttgatccaccactacccacactgtccactaacctactcatgctagggatctgggaattagccttctcctcacctcacatctccagcacttgcagtacagtggggaagtgagggtgaaggggaaagggagctaaggtacagacaatggctaatttacatctcttggtggcaagtgttacaacaggaatagtatacaacactatagagacatacaatgggaataaatccatgagttagtcatatgctcctttctagaccgttctctgggtactcactgcctgaaaaacatgattttttcttacaggtttcagctaattctgcatctcaccaagaaatttttccttgacaacctctccctaacagaattagttgtctctgttgtgttcctgtaaccgagtatccccatttttcttaagaaaaagggaatgaataactattattattttctcttctctttttccttttccccttgatatggtttggctctgtgtccccacccaaatctcatctgaaattgtaatccttccccatgtgtcaaggaagggacctggccatggggcgataggatcatgggggcagtttccctcatggtgttctcaaaagatctgagttctcaaaagtgagaagtgagttctcaaaagatctgacagtttaaaggtgtgtggcagttcccccttcattctctcctgtcaccttgtgagaaggtgcttgcctctccttcaccctttaccatgattataagtttcctgaggcctcctcagccatgtggaactgtgaagcaattaaaccttttttaaataaatgagccagtctcgagtagttcttcatagcagtttaacaatggactaatacagagaattggtactggagtttgaggcactgctataaagatacttgaaaatgcagaagtgactttggaactggataatgggcagaggttggaacagtctggcgtgctcagaagaagacagaaagacatgggaacaagtttggaacttcttagagtctagttgagtgattttgaccaaaatgctgatattgatatggacaatgaagttcaggctgagatggtctcagatggagataaggaacttattgggaactggagtaaaggtcactcttgatatgctttactccagagactggcagcattttgcccctgccctggagatctgtggaactttgaacttgagagagatgatttaggttatctggaagaataaatttcctttttttttgagacagagtctcgctctgtcacccaggctggagtgcagtggcacgatctcggctcactgcaagctccgcctcccaggttcacaccattctcctgcctcagcctcccaagtagctgagactacaggcacccaccaccacacccagctacttttctgtatttgtttagtagagacggggtttcaccatgttggccaggatggtctcaatctcctgacctcgtgatctgcctgcctcagcctctgaaagtgctgggattactggcatgagccaccatgctcagcctataaatttctaagaagcaaagcattcaaagtgggatctggctttttctaaaagcctgcagtcatatgcattcacaaagagatgatctgaaattggaacttaggtttaaaagagaagtagagtgtaaaggtttggaaaagttgcagcctgaccatgtggtggaaaaggaaaacctgttttttggggagaaattcaagtcagctgcagaaatctgcaaaagtaaagagaagccaaatgttaatagccaagacaatggggaaaacctctccagggtgtttcaaagttcttcacagcagtccctcccatcacagactcagaggccaaggaggaaaaaatggtttcgtgggccaggcccagggcccccctgctttgtacagctttgggacatggttccctgtgtcccagctgctccagtgccagccatggccaatggaggacaaggtacagcttagttcattgcttcagagggtgcaatccccaagccttgatggcttccacatggtgttaagcctgcaggtgtgcagaagacaagagttgagctttgggaacctccaactagatttcagaggatgtatggaaacgcctggatgtccagggagaagtcagctgcaggggcagagccctcatgcagagctcatactagggcaatgcagaggagaactgtggggtggagcccccacacagaacctccactggggcaccacctcatgcagctgtgagaagaggactactgtcctccagattcccaaatggaagattcactgacagcttgcactgtgtgcctagaaaaactgcaggcactcaatgtcaggacttaatgccacccaatgaaagcaactgcagtggctgtaccctgcccagagccacaagggcagagctgcctaaggtcttgggagcccaccccttgcatcagcatgacctggacgtgaggcatggagtcaaaagagattattttggagctctaacacttaatgactgccctattgagtttctgatttgcacgggggcctgtagcccctttgttttggccaatttttcccgtttgaaatgggaccatttacccaatacctgtaaccccatcatacactggaagttattaacttgcttttgattttacaggctcataagcagaacggacttgccttgtctcagttgagattttggacctggacttttgggttaatgctagaatgagttaagactttggggtactgttggaaaggcatgattgtgttttgaaatgtgagaaggatatgagctttgggcggggctgggatggaatgatgtgatttggctttgcatcccaacccaactctcatcttgaattgtaatccctgcatgtcaagggagggacctggtgggaggtgattggatcataggggcagtttcccccattctgttctcatgatagtgactgagttctcaccagatctgatggtttaaaagtgtgtggcagttcccccttcatgctctctctcccgctaccttgtgaagaaggtgcttgcttctctttcaccttccaccatgattgtaagtttcctcagtcttccccagccatgcagaactgtgaatcagttaaaccttttttttaaaataagttacccagtctcaggtagttctttatagcagtgtgaaaatggactgatacacccctgttctccactttctacttagtcttttagtaatgacaatatagccttttaccatccccttcaccagacgctccctacagggtaagttcatctatgcactctaagacggaactctctttgagagttaacagtcgatttatagaccaaagcatgcctgctatggaactctcacccaccagagggttacctcaagagataacaattgaaaaacatgtccgctactgtctcccagctagggagtttttatcatagtcctgcccacaaaaatgccagaagtcaccagcttgacctcctggtatgtaagggaccaagctaacatgcagacccctcaccttgctcacttcctctcctgccttttaaaagtgcctgctttaggttctcactcataagtaggagttgaagaatgaaaacacatggacacagggaggggaacaacacacaccatggcctgttgggaagttggggatgaggggaaggaacttagaggatgggtccgtaggtgcagcaaaccaccatggcacacatatacctgtgtagcaaacctgcacgttctgtacatgtatcccagaacttaaagtaaaataaaaaaataaaaaaataaaaagaaaaaagaaaatgaaaaaacaaaaaaaggaaaaagaaagtaagtgcctgcttttgctccagaaacaaagtagtacatttaaagtcaagactcctgtgcttcttcccctaagctagcttgggaaataaatcactttgtttataccagacctcgcttttgttaattgggctctgcaagcattgagtgactaacctgcatttattagttacattctcactgcatttgtacttgtctccattacaacaattataattatagatacattttaagttactatggagccccagcagaatgcctgtcacatcaaaattatcaaagaagtatttagtaaagagaagaaaaaaaagaataaacagaagatatcaacagctctggattctaccagtgaccagcattcaatcaactctatataaattattctctctgttcctatattttctcctttgtccagtaagaaattggactcatggccagatgcagtggctcatgcctgtaatcccagcactttgggaggctcagtggggtggatcacttgagcccaggtgttctgagaccagcctgggcaaaatggggaaaccccattgtgggggttcagtcaggctggtgggaaaaattttagttatcatagccacaaaccctcttggaaggcctgagagtttgcataacttcagtaatagatctagctgaaggcagcctagtccctttacctttagttaaataggttaaagtagatacaaaggaatgtgggggagtttatctaactagcttgtttactcatgtggtcctaagactaatcttagtgtgcttaattgctttctactcgggaggtccgcaatgtcaattaccctctagtggtgttgactcaagcctttgtcaattaatctttactgaatgaatgtgagtcttgctgtgtctaggctggaggttccaactatttacagcactcttcttggtgtctgtaagtggtctggatgctcagccagactggcaaagcagaatatctgtgtcagtgcacgttattcatctgtcattgggtcagggtctgcaggacagacccctgcaccccatctctacaaaaaacaccccctgcaaaattgtctgggcatggtgccacatgcctgtagtcccagctacttgggagactgaagcgggaggattccctgagtccaggaggtggaggctgatataagccaggatcatatcattgcacttcagcctaggcaatagaatgagaccctgtctaaaaagaattaaaaaaaaaaaaaaaggaaagaaaggaaaaaaagaaaaacgatatggagcttgaactttccttgactttgggcacgtcacatggcttcgatttcttcatctataaaatgtcaaccacagagttattgtgaagatcaaatgagctgtgcatgtgaaatgaaactacctttacaagcattaaatgctataaaaattttaagcatggcttttagtagttttagctctaattttctattattctaaatagtggaatgtggtagaagtatatcactgttttttctttttttctttttaaccagtggtggggataaggggaaggaagtggttgaaaaatcgaaagggaacttcttacttgggtaagtctggacttaattgtgccaaactttctaaagcagcttccaggacaaatttccaggaatatttaaaaaattgtttagactgactggaacacagatatgaagccacattttttgtgcacgtgtgactatgtgtgcctctggaagatttcaacacaaacacgctctcatctaaattaacgctttcctctgaattgactcatttgaccagcataaccagtttgcatgccagtgcaagcagagaaagttgtaataaaaagaagaaaagaatgaaaggcatttagaaattcggtggttaaatgtacacttagttaatcattgtatttgtttttcaagggcttcctaaccttttggagaaagaaaaatatggcagaaagctgactgaagtttgaaattaatatgtgcaaaatgtctgtagaggatctagtctatcctcctttccttcatcttaagacttaattttatccaaaaattaagtagcctgattagtcatccttgctttcttctcttcctggctccttgggttttttcccacatgtatttgttcagcatctattacaaagcaggcactgcccaaggcattgtttttaatgtacaagtagggagtttgaaattcatcctttcgatcagaagttctcaaactatacggtgtatatgattcacaaggaaaatttgtccaaagtgcagatttctagtcttaatcccagatatcagatttgaggctcttcgtggggcctggcaatctgccattttaacaagtgtctgggagagctgtggctcatgcctattatgccagcactttggaaggacgatgcaagaggattgattggaatttgtgaccagcctaggcaacactgcatgactctgtctccacaaaaatttaaaaaattagccaggtgtggtgttgcatgactgtagtcccagctatttgggaggctgaggtgggaggatggagtgagctgtgatcgtgccactgcactccagcctgcgagacagaggtgagaccttgcctcaagagacaacaacagggccaaacgcggtggctcacgcctgcaatcccagcactttgggaggctgaggcaggcggatcacctgaagttgggagtttgagaccagcctgaccaacatggagaaaccccatctttactaaaaaatacaaaattagccaggcatggtggtgcgtgcctgtagtcccaggtgagacaggagaatcgcttgaacccgggaggtggaggttgcagtgagcgaagatggcaccactgcactccagcctgggcaacaagagagaaactctgtctcaaaaaaaaaaaaaaaagacaacaacaatggccgggttcagtggctcacgcgtgtaatcccagcactttgggaagccaaggagaatggattatctgaggtcaggagttcgagaccagcctggccaacatggtgaaaccctgtctctactaaaaatacaaaaattagtcaggcatggtggcagacacctataatcccagctattcagtagggtaaggcaggagaatggcctgaacccaggaggcatagtttgcagtgagccgagatcgcaccactgcactccagcctgggtaacagatggagattccatctcaaaaaaaaaaaaaaaaaagacaacaacaaacaagtgataagcaattcaagggactccattcacctgtttgaaattaataaaacacttagtgattagattaggttggtgggcagctgaactcttcaagattttatctatatctctttaagaactccagaatcggggctctctgttcgaatccagactctgccacttaggagctattcagttgattgtattaatcaagttaacctctttgtactctgtgtcctcctctgtgacagtacatgggaatcaaaatatctacctcagagagtcactgggcagatttagcagataaagcatgggtgttatctggcatatagcagtaagtacaaaaaagtagctacaataataataacataacatataaattaatataataacattgttaccattattggcagtagttttactgtggctctattttttagagagaagagagaagacacaaagttttgcccacaataagtggtcaggtcttggaatatgactagatgattgcttcaaaagagagaagtgttctgactgcttgtatatgtcttctgaggcggaaattgctgttagtaacaaccattttagtttacattttctaaatattattaaatccctgagtagtaggtaatattattgctattctgacattttcttctcatggcttaatttaaaagaatcaaaattatacccagctcagagaggtaaataacaaatgttctcaagaagcatctaaggccaggtgcagtggctcacgcctgtaatcccagcactttgggaggccgaggcaggtggatcacgaggtccggagttcaagaccagcctgaacaatacagtgaaaccgcgtctctactaaaaatacaaaaattatctgggcgtggtggtgggagcctataatcccagctactagggaggctgaggcagggaactccttgaaccctggacgtgcaggttgcagtgagctgagatcgtgccactgcactccagcctggacgacagagtgagactccgtctcaaaaaaaaaaaaaaaagcatctaaaacaggggtccccaacccccatgacacagattctggtccatggtctttaggaactgggttgcatagtaggaggtgaccagcaggcaagcaagtgagcattaccacctgagcaccacctcctgttggattagtggtggcattagattctcataggatcgtgaaccccattgcaaatcgtgcatgtgaaggagctacattgtaagctcctgatgagagtctaactaatgcctgatgatctgaggtggaatagtttcatctggaaaccattcatctctcttgtccatggaaaaattgttttccattaaactggtccctggtgccaaaaaggctggggactgctgatctaaaagatgtcctcatcataatcacagataatgaatacagaatactcagtatcggaggaaagataaaaagttcagtttgggtcaatttcttcactatttacatacacttagggccttagacccttccatgctaaaatttaaatgcatgcattagctcatttaatctataatagccctataagtaaattgctattataatccttatttatttatttatacatttttttgagatggagtctcgctctgttgcccaggctggagtgcagtggcataatcttggctcactgcaaccttcacttcccaggttcaagcgactctcctgcctcagcactccctgggactacaggtgtgcaccaccacaccacactaatttttaaaatattttttagtagagatggggtttcaccatgttggccaggttggccttgaactcctgaactcaggtgatcagcccaccttgacctcccagagtgctgggattacaggcgtgagccactgcgcctggcctataatctcattttaaaagatgccattataaaacatctttaaaaatgaaatttattctctgaagtgtcaacataataagaaagaaaaaaaagacacttaggttaactaaagtaataaaggaactcaaacttgaaccaagagctatgtgatcttacatctcactttagtctgcatatcaaaccgcctcctagacactttgaggctcacgggtctgaagtgggtgtagtggcatcctgggaagatttaataggacaacaaaggtaagtcacacaatgagctctaaattctagtctgtccaaagcatgctcctttctaaaattatattctaaaatgttaagaaaaaatacaaaaaagggcattttcagaaaatgttttatagtccttcctctgaatgactaactttaccttttttctacattgcatattctttatcccaaacatatgcagaacatgttgatgtgttctctgattacaaagtgttttcaaatgataatgtaatgactcagtagacttgtgaaatgcaggcagaaaaaaatcatttaaaaccaaaattgactgtgctgcttctacctgctaagggaagtggtctaattcgcatcagaggggtaagaggcagagttcccttccccttttgtaaaagaaaaatggggacagcaagcaaaaaatcactcaattgttaggaaaaaatatctaagccaccctctcaccttccttctctttcccaagaattggttgcactactgaaaccagaggagtgcaggaattccactattttgtaaaataagtttgagccaaatttgcctgaatttctaagacaggctactttggttgatacacggattaagcctaaaaataaaaccttttgagataaattgggtagtacacccacagaatcgcgcccgagtcaaggagggaaatccttttggtattgtgtttaaaaatcatttttaattttccctacaacgaagcgaaactcctcacatgtgtttaattgttcgctctgaaagactacacaggccgttacgaaaatagtttttggcatgagtagtgatctagttataaatcagtgaaaaataaattgtgtccataaaaaagttacagaatttacccctgtgccattaaatattagttaacaaccttgatttttaaattgatgtgccatattctaccatatcgatactgtatttgatatggttcagttgcagactgctcttccagaataaataggcagaaaggaatttatcactggctgcaaaccattagatggcttacaaactgtttggaattgtaggggcaggcgctgtgtgagcgtttaggaacaacttccattctccagaaatggcatgggtagtcctgcgatccaaaggcagcagtgtcaggtggaagcgctagaagcccgaggctgccattggcagaacaaagcagtctcggcctggcttggcagcatccaaaaggaccgcagccgccctgccgctgcacacggtgcatctgattggcggaacccaaacccttccgcagccctccctgcgaagatatctgggaaacgtagtttttaccttctaacctctaaggcacggaaagcttattcgatgttgattgtaatggaaatagaactatgtattaggatttgtttaaccatcccttgagttttaaattttttggttgttacgtaattttctctgtaataaataaataaaattccctaaacaatatgaatacttttcaaatttttgataatgattgcaaaattgctctcttgaaaagttatgccagtttatactccttccagcaatctttgttccatattgtcagtcatgattaatacatttgtcaatgcttttgaaaaggaaagtgacatattatttaaaaactatgaatttctttggctagtttgaagattttaattctcaccacaagtgaattacgattagatttttttttttttttttgagatggagtctcactctatcacccaggctggagtgcagtggccaatctctgctcaccagcaacctccgcctcccgggttcaagagattctcgtgcctcagcctccagagtagctgggatttgaggcatacgccaccacactaggctaatttttgtatttttagtagagatggggtttttgtcctattggccaggctggtctcgaactcccgacctcaggtgattctctggcctcggcctcccaaattgctgggattataggggttagccctcgcgcacggccgcaattaagtctttagacgatctgtttccccagtatttcccagcaatgtatttatgaatcatctcgcatctcgcatggtgagaaacttaacatgaacgttcaaccatgtaaaattattaccagtgaaataaataacttaatgtctagtgacctcttactgtagctctgtattggtagatagacacttcttttttgatctttcaagtatatagtaaaaaaaatgttccttttacagttttcaatttttttttttttttttttttttgagatggagtctcgatctgtctcccaggctggagcgcagtggcctgatctcggctcactgcaacatccgcctccccggttgaagcgattctcctgcctcggcttcccaaggagctgggattacaggcatgcatcaccacgcctggctaatttttgtattttctttaaattagagacagggtttcaccatgttggccaggctattctcgaactcctgacctcaagtgatctgcccgcctcagactcccagagtgctgggattacaggtgtgagccaccgcgcctggctaatttttcatgtttttagtagagacggggtttctccatgttggccaagctggtctcaaactactgacctcaagtgatccacccgccttggcctcccaaagtgctgggattacaggcgtaagccatcgcgccctgccttgttttcaaaattaaacttagttgaagcctgtaagacttaaaatgaaagcaagattatgtgacttgattatgatgcagccaaatgaatttagatgcaaatgctagacttgaaatgtaagtgtacgaatatacagcagtataattttatgaggtctgggggttacttgtgcatgagcccaggatttagatatctggctactcacagtaagatccatggaaggaaataaattctataaggaagcactgtataactcaaagaaactagagaggcccaaatgtccaaagctgccatttcgcttgctggaatttgctggtggaataactacccttccccgaattaatgaggctaaatgaattcctggggaaccctcaggctgtcagtgtaacacctcccacatcttttttctccagcaggtggcatgtacagcaccatcctgaaatggtgataactttattattattattgtcactattcatggggctaaccatcttcccttttcttcccaaataagtacatggagttttagcataggtattaaagaaggctcgtcagcatgatggcttaagtctgtaatcccagctactggggaggctgaggtgggaaccgaggagttcaaggctacagtgagctatgatcatgccactgcactatagcctgagtgacagaaggagaccccgtctgtaaaaacaatttaaagagagaaagagaaagatagagagagagagaattcttgtttcaatgacctagaggaaaaaagatgttataagttcgcttttgaaactggaacattaatttttcaccatattaagacaagaccctgtatatacacgttaaacttaaacagctatcttttaggctgttgaatgcaagaaggtaagtttaagtaccatctagtggtaggcatcaccctccacctagtggcatccctctccatctagtggcaagataggcgaattgaaagcaagtgccaaagaagaaatagtctgatactgaaatgttgaacaaaagtttaaaaagacaacagtattgaccacgcctcctccaagtcccagcgagcccgtgtacaacctgtcccgactccagccgcctcttcagctcgccatggatcccaactgctcctgtgccgccagtgactcctgcacctgcgccggctcctgcaagtgcaaagagtgcaaatgcacctcctgcaagaaaagctgctgctcctgctgtcctgtgggctgtgccaagtgtgcccagggctgcatctgcaaaggggcgtcggacaagtgcagctgctgtgcctgatgctgggacagccctgcccccagatgtaaataacgcgacctctacaaacctggattttttatgtacaaccctgaccctgacgtttgctacattcctttttctatgaaataatgtgaatgataataaaacagctttgacttgaaaaaaaaaaaaaaaagagaatagtattaaagtaccagataaactttaccactgttttattaaattttaatataaataaactatgtaaaataattcatgattgtagcaggttatctaatttggaaataaaaagaatactcttgctggatggtaaacagactattcctagcatgaggtcttttcttggaattattttatcttagtccttacctagaaggacttaggaagtgacaaacagtgctaaaaacctgagagaaaagttaagacatagtgacagaattttgcaggacaaaagagtgatattagtacagtctttcttatgttaaaccttttatgatcttgaaaatcttatctttaaatcttaagaagctgttggattatactttaatcattgcagggaaaagatttagaaattatgttgtcaaccagtttagatcaaattgacatcagaattgggtctttaggaggagatttttggtacaataactttgtaatctgaggatactaatcagggtataatagtacacttaattagtatgattagctgatagtctcaagttaggacgacagtcattgagcccatatcaggtagttaacagtgagcatctatctgttctaatatgttcagcattctgttaggattagttggtgtccatgctgtccttgttattaaatcatctgaatatcatccaagaccataagggactgtatgttcacaggaaaaaaataacaaaatcacaaaatgtgaagaatgtatgtattatgaaaagaaggtaggcaaacagatatctttaaaagaggaagctaaaaaaataaaaataaaagaggaagccaaatgaatggatcagatagaaaaaaatgttcaaaagtgtaataattgttttaaaaggactaaaaatatttttagagacccaaaggaggaaattagaaacatgaatcagaaaaatcagttatgaaggaccaactggagatattcagtatgaaaaacctaataactgaaataactcagtaagtatggtattagataaaccttatagatgttttttagatactgcttttcagagtgaacacacttgaaatacaaattagtgagctgaaagatcaggtcaatcaactcttctagaaggactcaggaaggacaaagcagtgctaaaaaactgagagaaaaggtaagatacagtgacagaattttgcaggacgaaagagtgatattagtacagtctttcttcagtatcttcaaggattggttcaaggacccactgccttcatagtaaaatccaggaatgctcaattcccttatataaaatggcctgtttgctcataatctacatacatcctcctgtatacattcaattatctctatattacatatgatacctaatacaataggaatgctatgtaaatagttgttatgctgctttggtttttatttgtatttttttaattgttaatttggttttttcttgaatattttcggtcccaggttgtttgaatctgtaaatgcagaacctgaagatacatagggctgagtgtatttgatagaaagaggacagagaaattgttgaaataagagaaatttgaagctaggatgctatatccaattaattcaatgtaaggctgaaataagttattgtaaggtacacaaggcctcagaaggctgacaaaaattctgtttgaaaacactttgggaggatgtgctcaagtaagacaaggaatcaatccagaagttaaccaagagatgtgaaaagtgtggaacaagtgaagctttgtaacgtgtttagatgaaaaactgccagaggcatctttaatataaacagcttcaggaagagagacacactgtattgctttctttatcccagagattttggagcgtatacataggtgtcatgcatgtcgtatgtatatgtgcgtatttgttggaggaacaaagcccaacccccacccccgacaaaatcccatgagtttatttacacattgtacatgagaatttgcgctatttcctatcttcagacgtgatatttaaaatatataacaattagtacaacatagggcactgaccaatcagaacagacaccagccaaactgctagagcagcttcctggatgctgtgcccttcatgtccggattatgagtacacctctggtgggctggggcagaggcatggggcagggtctcaaagtggcttctatttaccatgtatataggattgtttcaatattttaacaacttgtatggtcatgtatactgactgaatagcaactctgctatgagacataagacatgtttgatgacttcatgcaattttctgaaacatgctctttttttttttaaaataaaccttgggcagatgttatgttaagacagtctctgtagtaaaataatttgccatattggagaggcttatcatctttacaatgaaagtcagaaaatataagtaaaacatattaagttgtactaaagcagagagaataatcaaatataatcttactcaagatattttcatgacaactcagcttgcaagatgttttcctaggcttactgggtcataaatattcggtatcattttttttcctatattttaaagaaaaggaatttggaacatgtaaactataaatctaagttttaaaaaatctaaacaacagtttcctctcattgcagacctcattcaaattgcaggctggagccatgcccaatatgcctcttcagagccacaactacccacaggtaggtgggcacttggtgagtgaggataaaaagtttgttgttataagtcattgagttgtgcagttgtttgttacacagcaaatgacattccttttttacttattcatcattcattcaacgtattctaaacatataactatgaactataaaaactcaaaactggcttttcttttaaaagattgactagacaaatttatgttaaaactaatcaggaaaggaatggagatgcaaataaacaacagcacctatgaagtttgcattctactattgaaacagaaaatacacaaataaactgggaatcccaaatggttcataagcaaacgaagagtgacttacccttactctgtaatcagagaactgcaaattaaaacaattggaaagtctgacaatatcatgcagtgatgaggatgttgggaaataagagacctcccattcaacttaagggaaagtaagctgttgcaaccattccagggagcaacctgaaagtacttggtaaattaactatctttatactttctcaatgatgtagcaattacacttctaggtctcttgcacatgtccctaggaatatttttcacagcaatgtttgtggtagtaagaatggagaaagtctagatgtccattgacagaggaatgggaaataaaataagggatagacacataataaagttatattcagcactcagaaataatgttctagattaatatttatctggatggctcttaaaatatcatgacaaattggggaataaacaatatgagatttataaaagaataactttcaaggatattacatgcatatgcccagaaacaccaaattcatctttaaagatacacatatatctaaatgaatatagcaatgatatactggtagggtataaattaaatatgtaagggtggggtgaggtgagaatggtggatgcatgggaaaaaggtagtaaaaagtagaaaggtaaaatttaaaaaggggtattgcacagacgctgaaaatgtgcaatgaaatgaagggtgtgattaattcaattttgtgacttgatagtctaaaaataactatatgtagtagaatctgaaatatgaggaatagggaactttaagggagtatatggaagtcaacgccgtctaagcatgtgcacactgaattctcacactttcgatgatgtcctgctattatatcttttctaagcttagaggaagataaataccacagtagttatattttaattctagttttatttaggtaaatgataataatgagataagccacaaagttcgaattgacatatctattagtattagtatacataaatgtagaaaatatatttcaaaagaaaaaagaacgtactatgatcatcaaaaacctcacctttccacatgatacatattgttgatattttgatatttttccaccatggaatttattttgcaattaccttgttaatcagtataatgtataatgtgaggattaaattgcatctatggatcttgatgtgttatctttagaacttatttagattgaagctttcattttatctttttcaaactactatattaatgatcttgaatgaagattattataggagttcagtgcctcgcaaaattttcttgtacttaccctgtgcttcatactcttattgtcttgcctcctttgaataatcacaaaagaaaaagaaggcaaaggactatatagcacaacctattagaggaaatggctgaaatagtattctcttaatgtttaatgtgactattaagagggtattatgctggcatgtaaaacagttaattgtattcagtgtgttttaacatcactgattaattgatggcatagtgaatgttcatcttggagaaaataccacctttgtatctcaggggatctaaagaatgtcttttgctgctgaataaagtgcttcaaaaagttcaaagggagaaatgtgtatttttttttatggtaaggaagaatagattttaccacttgggaaagtaacagcttatgaaatcacgcagtgatgactgtaattcagctgtcgtctgtttctttcaccttctaaccagtgaaaaaagttaggttacttatttctttgactaagtaaattgaaaaggaataaattcagaaagattatctaaggaaactggttattagagcaaaatggtttgtattcactctgtaaatgaatgctcctgctgcttttctcttcattttaatcataatatttcttttttccagttgtttcatgtgaattttattttattgtttgtttttgtttttgagatggagtctcgctctgttgcccaggatggagtgcagtggtgccatgtcggctcactgcaatctcctcctcccgggttcaagcaattctcctgcttcagcctccccagtagctggaactacaggcatgaggcaccacgactggctaatttttttgtatttttagtagagatggggtttcaccatgttggtcaggctggtctcaaactcctgacctcaaatgatctgcccgccctggcctcccaaagtgctgggattacagcttgagccactgtacctggccgtgaatttttaaatatatcacatttcaaaataattttgcagttccaaaataattattttgtaattcaaagacagttgaataagcaaatcccttgggatttgattgtgtcagaattataaggtcctgcttatttttatttttatttttggaatttgtctgatggttgcagattattgtcaccggttcctcacgtttgttcccaaaagaagtaggatttgtgagacttggttccacctttgattttgatccatccctctgaatcaggctaagtcacagactccctaggtcattgccacaattttataagtaaggcaactaaaaataatctatagtactcactttcaaaagatcaatcactcaattcactgagtgttaataactgatttagctcagggagaaggacatttctcttattattctctataagaaggtaaaatatctaggttcttacatttttgaatagcaaagtaatgttgaaattagatggacaccttgacataaatctgaataaaaataacatatctcaggaatcttttagtattatattattgatataaaaattattaaaataggctgagcgctgtggcttacgcctgtaatcccagcactttgggaggctgaggtgggcggatcacgaggtctggagatcgagaccatcctggctaataaggtgaaaccctgtctctactaaaaatacaaaaaaaaaattagccgggcgtgacggcgggcgcctgtagtcccagctactcgggaggctgaggaaggagaatggcgtgaacctgggaggcggagcttgcagtgagccgagatcgcgccactgcactccagcctgggcaacagagcaagactccatccccccaaaaaaaaaaaaattattaaaatagcaatattattaatgtctacacttggtcttagccaaaaggccaagaagatatagtttcttaaatttctgagatctttctaatttataaaatgctttaatatacagctttatttttattaatttaatttaatttaatttatttattttttagatacagagtcttgctatgttgcccagcctagacttgaactcctgggcccaagtgatccttttgcctcagactcctaaatagctggtactaggcgtgcgcatcactgtaccttacctccatacgcagctttttagaggcagaaactatttcactgacttctatcccttaaacccagaaattgccagacataggttaataagtgcctaaagtaaacttcagtcttttgttgctgtttcccacctcctatatttgaggaattctctgcaatatgtatctttaacagaagctccaaaggccatgtgctctatatcccatctttctcttcaactacagcacagtaacgtaacttaggctcacctgatcagctgtacccagttgaactttcgctgggagctggtgatgcaaaagagtagcaatggtggagaatctattctgatagtggcagcagtatagatagcaacaacctgttccagggcagtagtggaaatgaaactagtggtggcatacggtggctggtgcctgaggtgatggctgtacatgtggtggcatccagtgttcagccatggtgggagcagtccccttatgaccctggatctatggttttacttgtggatctggctggtgcatagtgctcattgttgatcttccctttttcaaaacttgtttctttattcttcttgacaattctcttagatatataaaatccttttaataaattctgcttaaattagaattggcttctgtcacttgcattaatatacttgacaaataaaatatgaaactgacttgcatagctctataaccctatcaagacaggttttacgaatactgtttatatatcagtaagcaaagactaagagacagtaatttacttggctaagattaacgtttagtaagaacgaagagccaggaatcatacatagtcactccgattctatgcctgggtctctttcttccctatcacagtgtggcagagatgggttaattttctaagtacacagaaagcttacatttcacaacttctcttttaattctcagcatcatcacttggtgtagagtcccccagagagcaacctgatccatatcacaaacctgagacaaattttggttgccttaagcccttacaatttggagtttattcttatagcagctaatgatctttactccaattaatgcagaaattagtaacaaaattgaggtgctgtcataacaaaaacttaaaatacgtgacattgacagctgttagctggatagtgaggagagagataccagagatctatgttatatggtggtaaaatttttggtaaatttattaccttcttacaagacagaaaatgtacctactgggcttgtcgttttagaggaagagtttgcaaaatcaaatgttggcagagtttgttgggactgttggcttatttggaaaagtgtagtaataaaagagatgttcccagaagaagattgaccaattgatgaacagaaatgaaagtagagagagaacagaaatttagagcttttcaagttgaatagtcctaactttgaaaccctaaatggtaagaaatggacttacaaaaggctttgaatgaaagaagtccagtacaacttgacactaatagttggataaagggactcacagcaaagatcagattagggtatgccttacacattgtttgctccagatagactcaaaatacctgccattaagtaaaaagaggaaccacagtggcaaagaagcaacacagatcagactagacaatcatttctaggaataaactattggtatagttactggcacgtggatttgattggaaacaaacagatagaagaatataaaattttgaataaatgattttgccaatggagtcatgaaattgcaataaaaaaacacgtaagatatcagaatttaacacaacctgcatgtcctagaccttcaagcaggtggcaggcagtaggcagtagacttgcacattcatatagctgccaaaaaggtcatgtgccccagttcccactgcagatgcggtcaaggagaataacagacagggggataccttccagagggtgaggacattgcataaaagaactctctccagaaggcataaacagtgcctaatgaagaatttctcctgtccccaaggcaatgtctgcccaatgggattttaaaattgccccaaaccagttgctgtgtttctttttccccttctaaatggaagcgtttattgtggtaattgtaacccttctccaccgttgtaattagatatgtatttattgtctttttagttcataggtctccggagcctggggcatcgcatctagatggaaaggactgaatatcaactgaagagcctaaattttgggctgatgcagtcagtgattaagagttttgagtcagtgatggggcgaatatgtttcatgtgtggaaagataaataaaagggatgatgcatgaccagaaaggaggactgtggcagaaacagcctagatgctcaccaatcttatttctactgtttgggcagatggaaactgctatagttcaaagcctctcttggagttagattgcaatcatatgactgagaaatagaatgtgagcgaaactcactggtgtcacttccaaacttggctctttaaatgttcttcacaatcattcatgtactcactctactgtcttatgactattgtacatattcatgcacataatgatgtttccatacatataatgtgtaataatcagatcagggagagtcgcatatctatcagctcaaatgtttatcatttctctgtgttgggaatgttcaatatcttccttctagctatttgaaactatatattattgttaactcctgtcatcctacagtagtatagattattataagttattcctcctatctagctgtaattttatatcctttaacaaatctctccctgtctctcagtaaagtatcctgagatagtggaacttctctggttaacacttggaaaagaattgctgaaaagagctgtctcaccaactttgggctgtgattttgttttgtgaagtcattgtgattttgggatggttgtttatagcagctagcaagtcttagcatggcaaatacagtaactgtcatactaaaaaatatgatgcagaataaattatgttaggtagattaaataaatctatattattaataaataatatttgtaagtctgaattttatctgttggaatgtcagaaaagaatggggattatataaaaaagaattgttagaaaccagagtgtatcctatataggatcattagtgaagaaatagatggaaaagtggaaatgaataactatttcttccacacagaataaaacccagaaacaaagaaaagttaagtagtattagatagtgattcccaagcctgggaatgggagtcagtgatactcacctaggagagaatattaggaaggagtgagtgacatgaaaaaaaaagtcacggagggaaagggtaaagttttagtaagtcctatggatgacaattatgtattacctgcagcttgtcctactagaggaatagtctctgtgccaagaggaaaaaaaaaggctcagaatttctgatctaagacataggtagttaagaactcaaaaggaaaaatgtagtcagtgtataagatgatggaaatcttgttttaagagaactgaattattggagaatgtgtaaagaagaaagaggtgttaaacttttgaaggggagtcagatttgctcacatttttaacctttaacagtttcccactttttttttgaaacggagtttcactcgtgttgcccaggctggagtgcaatggtgcgatctcggctcacagcaacctccacctcccaggttcaagtgattctcctgcctcagcttcccaagtagctgggattacaggcccgtgccaccatacccggctaattttttgtatctttagtagaaacagggtttaccatgttggccaggctggtctggaactcctggcctcgtgatctgcctgcctcagcctcccaaagtgctgagattacaggcgtgagccacagcgcccggccatactttattctttatgatacaatgtctcactctgttgtccaggctggaatgcagtggcagaatcacaggtcactgcagccttgacctcctgggctaaagtaatcctctaccccagccttccaagtagctgggaccacaggcgtgcaccaccacgcctggctaatttttaaattttttgtgggtatcactatgttgcccaggctggtcttgaactcctgggctcaagcaatcctcccatcttggcttcccaaagtattgggattacaggagtgagccactgtgcctggcctggatgggtaacctttgaaaagttatgtaaaatctgtgtgcctcaatgaggatagtaacagaaacttccctggaattacttgaagtttaaatgagttaatctatgtaaacaacctagaacgggccgggcacagtggctcacgactgtaatcccagcactttaggaggccaaggtgggtggatctcctgaggtcaggagttccagaccagtcaggccaacatggcgaaaccccatctctactaaaaatacaaaaactagctgggggtggtggcacatgcctgtaatccccactcctcgagaggctaaggcaggagaatagtttgaacacaggaggcagaggttgcagtgagtcgagactgtgccactgcactctagcctgggcagcagagagagactccatctcaaaaaaaaaaaaaaaaaaaaaagaacctagaacaatggctggcatagaggcatagaataagcattatatgtattagctatgattacaaaagaggaatctataaggtattctgcagacaaagagaaggaagtggctaatttagtctgcagagtagagaagaacctcagagagctgcaatttgcaaagcaaggaggagagatgaatatttgttttgttttgttttttgagaccaagtttcagtcttgttgcccaggctggaatggaatggcatgatcccggctcactgcaacctctgcctccaggattcaagcgattctcctgcctcagcctcccaagtagctggaattacaggcacccaccaccatgcctggctaatttttgtgtttttagtagagacggggttttaccatgttggccaggctggtctcgaactcctgacctcaggtgatccacccgcctcggcctccctaagtgctgggattacagtcatgaaccaccgtgcccggccgagagatgaatattaaaacatatttgagggactttagaaattgtcagtctttaaagtctgtaagaaggatggtctggatgactcctttagcatgaactcattatttagtagatgactccatcccaattagtatttatgcctgtggaaatctcatatgaagagctagatctgattagcagctctattatatctagcttaatgctcacaatttgttccacaaagccattctctctctctctctcgtctttccctccttccattttgttagatcacatattataatagttatatgctttaaacccttatttagaacaataaagatgactgacttacatttcagacattgtcgctccatgtcgctagttttaaaacctgcccaacttagtaataaaaagtaatggctcctcagataagagtttcatgatagtttcttagaaacgagtcaatgacactactgtaatagcaggggaaaagatttctaagtcacatcatattttcaaactgacaattttagctacaaaagtacaacttccaagaggtctttcccaggtaaacatggaagggatttaccagtccacagaaaagtgactgcctctcccttggataaatgagattctttgcttcctgaaaatgagaaactgctatttcaatttcaatgccaaagatcaaattttctgactactgtgaatgaggctgctcagcatttacaacactaaaaacaaagaaaagaaagccgaagaggaacaatttttttttagcatttgccccaggcctttgcaatcaaagcataacccagcttatttttggggtgactacaccctccattctccaggtagctgaatcttccttgcatgtgtgaaagcatcactgacaaagtttcgttgtcatggagtttttagataagtatctctgagtttaaaatcccaaattatatgcatccacccacccttatactataattaatatctgtcttggggctttttagaaataactacacacatcaacagtttcacaactgcttctgtgagtggtgagattagtaggcagatttctaggggaattatgcaggtgaccagtcattaatatgcacattgttaaaatgtttgaacgttgtcatgatgatgatacagcgccgatgagtggaggaacaccaagttctacgtcctcatgctggtttagataaaacgacactgacacacgtggagtggttttaaggagcggaaagtttaataggcaagaaagaaaagagaaggcagaaggaagaggctctcctgtacagagacagagggaggggggctccaaagccgagagagggaaccccatctggcagggataccagccaggtatatatacagaggctggaggaggcagtgtctgatttgtatagggctcaggggattggtttgacaaagcatgtcattcatatagcccaggaaaaagcctgccctcccaccctagccttttaatatgccaatgcagggcaccatgatgttctacccacgtggggatatgtgggggcggccatgttgccaggaagtgtggggcaaggtcaagatggcagtgggaatagccatgtttgggtggacccagtttctaatggatggcatttgcatatcaaaggttgccagcctggctctaagagctgctttaaaaacgaaaacttcccaaggaccccttttcctctctatctgcctaaaataatttcttaataactcctacaacaatgacaccaaggggccaaattctaagattccaccaacatgatgcagttggcttggcacttcataactcaattaaagggatttttgagggttgttgccttaggtgtacactgcatgctttgaagtttttcctcataaagaacataatgcagtaacttaggagagaccattaaagcatttttccctttaagaactgcagcaataattataatctggtagctactttcttatgttcttgtaagataactagtcatcaacaaatttttttctctattaatttcactgcgatcaaatatttctcaatgaaaataaaagataggaatttcctgtatatatataaactcagttattttgaaacaacacataacattagaattgagaaagaccatggaaatattgatttcagtgtgaatgaaaaagaaaaacttgggaccttaattcactatgccaaaaaagaaaaaaattaagctgaaagatgagtcatgcaagaaactgcctttccttttgttcctaagcagatagctacagataaaagttaaacatctccactgactgctactccatgttcaccttattttatgtaaagtgccgatttactgagcccaagatcaatacttaactgacaattcccctacttattcattttcctctgcagcttgtggattaccatactctccccttttcccctccagctggcttttcctctttaaatattgaagcctgcaaattcatccttggagaaaggcacagaccacagactgcttctgttattccatgttcatttcttcctggcatgtccttaaccttggcaaaacaaacttctaaatctatttagatcacagaaaggattttttatttctatacttctttaatgtgtttttaaatgtctgcctaatagttcatgcagttgatattccataatctcatcatgattgagtttatttctcagctgtatagaagaggacacaaaggaacagaaaaggcaagtatctcatccaggattacctagctagtaaaatgaatgcaggaaaaagggaaaggccaagaacagtcacatctatctgtcttttcattttgtttcttcttttgcttttcatgcttagaaattctttctccgcctagagatgaaatgaatattcaattatggtttcttccaattgtttctggtgctcatttttatatttatatttaacctaagataatctgggatatattttggtagaacaaataaattagatgtttgttctaagagaagtcttgatgaaatgattaaaaagtttatctataagaattaacagataatacaactgagaaatctttaaaaggaagagtactggaacaggtaacttgtactgacaaaaattgaaactgataatcatcgtaacaattagattagcatgcaccgttttaaggaaaacaagatcaattctatttagcataaaagcagcaattaaaatgatatgaaaatctgtttttctcagacagcatattagtttattaatttagtatttgataattttttcagatacagataatatctaagtgataatttaaaaaaatccaaacatcctaaataaaaatctaagccaaaatctcataacaagcctgtctcttaatgagctgtgacagtgaaataatcctttttacatggtgatagctgatattgtgatagctgtaaacttagctgtcatcacagatcttggctacagaggctgctgtggtaacgagtgaacctaatgggctttgtttacttgagtgaggagttttcttcatgccccaaccctgcccgcttgcaatgtgcatctgaagccaggaggatgtctctccaactgatcgtatatttctttcttgtttttcctttttttttttttttttttttgagatggagttttgctcttgttgcccaggctggaatgcaatggcacgatcttggctcactgcagcctctgtctgctgggttcaagcgattctcctacctcagcctcctgagtagctgggattacaggtgcctgccaccacccctggccaattttctgtatttttagtagagacggggtttctccatgttggccagcctggtctcaaactcctggcctcaggtgatccacccttctcagcctcccaaagtgctgggattacaggcatgagccaccgtgcccagccagatcctactatctttctacttttgaattgcaatgtggtttatgtctttggattttaataagcacaaaactcctcctagaattagcaagatatcaaaaaaggcctccaagtggagagcatttggccttgacctcatgtaggaaagaaaggagttggccaggtgtggtggctcctacctgtaatcccagcattttgtgaggcagaggaggatggatcacttgagctcaggagttcgagaccagcctgggcaacacaacaaaaccctgtctccacaaaaagtacaaaaattagatgggcatggtggtgtacgcctgtaatcccagctagtagggtggctgaggcaggtgagttgcttgaacctagaaggcggaggctgcagtgagctgagattgtgccactgcactctggcctgggccacagaatgagacactgtctcaagaaaaaaacaaaacgaaacagggagagtttgaagaacaataattctataattaaagtgtttttagaatagccctcaaggatcctctttctatcttttatactaccaaacctataaacatatatgtggtttccaggatgaggaacacaatacttgagatggaaaactaaagaccggctatgagctccaaggttgaggaacatatttgctgaacccttttccttaaattacatttatagaaataggaaaaatggaatatctccattaggcataattcaaaagcactgaagaagtgtagggatgtgaaaacacttctaaaaaagcaagcttggcaaaataccaacttttctcgaggaaccaatccattctatttttctgtttgtttgtcccaggttcttaagcagcatctgatttctaaactcttacaagggtagtctggataaagcacgttttattttctctgttgaaaactaagtattgcttaaatggagaatcatgccttatttggtagtacgcaaaggtttaaggcattttttttccttagatgagggatatcaatacagaaaagtctgtcactctgttttaaaatttatataagctcaaagtttcaagtgctagttcatgggggaaagaatttgtttattttttgtttttgcattttctatgacatcttttagcataaagccttacagagatcatttttttaaatagtagaaacataaatgcttattgaactgagcactctagccaaggaaaaacttttcattaattttgagataagaggcaaaaatgaaagcatattataaaccttactgattatttcttccttactttggctattggccatcttttagttgaagcatatacatttattaaatgtattaataaatacattaaattaataaagtcccatattaaagaagtttatggaaagatctctccttatgtcttagtgttctcttccaggaagagggtatacagactttataggaagcagatattccctcttatcttgtaatatatgtccttgtgcagcatgagaagaaaactttaagatcacagactagcctaagaaaaatgatttatctttcagcaaatatttctcatccataatttactttggcttacttctgtgtctacaagtgtctgttgtagcatataaatgaaactagtttcaaacaacttttcaggtgcaataacaaaatgtatgtaccagagcttctggatagctgaacacatgtcagttcctggagggcggtgtgcccagggatggcatggaagctctgtgccccttcccctatgtctcaccctatgcacctcttcatctgtatcttttgtaatatcttttatttactttttttttttagagacaaggtcttgctctgtcacccaggatggagtgaagtggtgcgatcttggctcactacaacctcctcctcccaagttcaagcaattctcctgcctcagcctcccaagtagctgggattaccggcatacaccaccatgcctggccaattattgtatttttaatagaaacggcatttttacagtgttggccaggctggtctcgaactcctgacatcaagctatccgcctgcctcggcctcccaaagtgttgggattacaggcatgagccaccgcacctagcctgcaatatcttttacaataaaccagtagatgtaagcatttccctgagttctgtgggctgttccagcaaattaactgaacccaaaaaaggggtcatgggaactgcaacttgaagcgcggtggtcagaagttccagaggcccagacttgcaactggtttgtgtgtagttggcagtcttggggacggagccctcagtttgtggaatctgactctacctctgggtagataggattggaatggaactaaagaacatccagctggtgtctgccgcttggtgtgttaggaaaaaactccatgcatttggtcatagaattcttcttctgtgttgatgactgttgtgttgtcagaggagagagaaaacacagttagggagagttcccctacacaattgatgtcagtgaaatgggatttgctagaacagccctcactcacagaaacatgtggtttaggaagagaaaggctaaaaggctgggaggatgaggaatctttgattcctgggtgaccatcgtggtcacccatgatatgaagttgcagttgtgttgagatcagttactacaggtgaaagttaccagcggaatttagagatggatagaactccccaggaattggttcactggatgcaaaagggaatgcaaactaataagaaaaaagcaaaatattcagtcctttggttgttgttacttaaaattgctaaaatgaaagtaaaatagggtgctgcatcaggacttgaagttggaccaagttcagatggggacatgtctgagcttagttaggccactagcctcaaagtcacacacaaaggagaaaattatgcagggacagtagaaagtacctctgaaacctgtggaagacagtcaatgtgaaggcagggcaaaaccaagtaactatttaaactattagagtaggtagttaggtaggcatgagcaggacaggagcgaggccccatccagaaatgccaggcaaccatcaggtgatggttagttggttgttaaactgttgctctaaaataataattggtcacagccagtgcagggaaaaacagtctcccaataaatagacaatacctgaaactggtgatcagcagcttcctgataagatttcaggagttgggtgaacaggctcaagaatgcccactaaaaagcaaaatggcagagattaactggtatatgatctttctctaggaaaacctgactggtaaggaaaaaatgcctcaaatgagcatgtgtacaactttggcaaacacagtgtgcatgttgcccctccccaagtgctggcggaccagtgtgcatgcagatagcccaccccaagggaagaatcaggggagaagaaatgcaaaccttggaacgatgccaatgtattctttcctccttgcaggcaagaatcgtttgctgcagacctgttggattcacagctggtaacaaaaccggagagtatagtgtgaaggaattgtttcatttttgtagaatggtgttatcagcttcctgaggaactattgctaaaatggattataagaatgacaaatgtaggggcagtgtctttggtttcaaatcttgcagagtgaagagcatgtttgggttgatataggacccacagctgaccatttgaacaatcacagatgggtatatatgatccagatatgtaggttattccgcaaggaacagccagtctgatagattggataaaagccattataagatctatttgagaaggtggactgttgaactccacctataaatgccaagtggaacaccttacataaggcagctgatacaattcatatgcaagccatgtgtgactggctttatgaggacatgaatattcactcagtgaatatgtccattacccaggtcacggtaaatactctggttaaggggaccccatgtgacattactcctgcagactcaaatagttcaagaagccttatcaaatttgtggactgagtttcccctcatggatctcacagatgctaataaaaacattaggttaattaataagagaacagtgaaaggcaaaagggagagtcaaagactcatccccggaagatagaaattttaaaatggttattaaaaaataaggtgaatgaagaaaacattgatggggtgaaactaagaagaaaaagaaaggggagagtcatgggactcgtcccagcagaatggaaaactttagatgcttattaagaaatagaatcaataaaatagacattgatggggttaagcaaaggtcttaatacaacactattgtaggttggatggaccagagggggccccatcttgtcccccaacattaaaaggccgcaaaccagtctgctgtatttctgccagcttggagaaatttaaaaagctggaaggcagagattacaatgaaaaatcagatctaaaattgcctggggcaacagtcaggcagactaatcgagataaagattaataaaagggccagggtccttgggctcaatccttggctggggacccaaagctttttacacaagagagggtaaaatgacctgggggtaaagaagagaagatcctgaaactagaacataaaaatgtaagagttgataggactatggaagttggtatatttgaaaacactttatgtgaagtgattgcatctcttttacctgatttttttttttgtgggaatgaacaaagtatctcattgggaaatatttctcctccctggtgctgtaaaacagaaggcatgtaataatctgccctcaagcaatattaattggacatgctaaatgggaaccagtgagattgcccaagtccacacagtgcagagtagaagctagaatgctgttatggataaattctccacttgataagcctctgtgatgctatttcctggatcttgtggcaaaagcctctgagcacctcccagcaacatctactgggactttggactatggaacttccatctgaggggcatttactgctttgctgtgaaatgttaggtgaagctaccgctattaacacctgaaatacccatgttggcccagcgatgtcagagaaacattctaacagggatggcagtgcccaggagagttccataataaaatggacatggtttatcgaggatcatgccacctaagaactgcaaggaggggatactcttgagcagggtgtttcttttctcctgagactgactctggaactgtgtgagaaactgctggattctacagtgcctgataaatggctctcaactcatgagaaagagctacttagtttgtggccagtaattccaaggtaaatggacaccattgtgtttggaaggcagctactttgataaaagaaggtaaaaacagatctgcttggtgggctgaattgcacactgtttttctaacagtgatggaagaattgatcaatggtaaaagcccctgagtttgggtgtttactgagctgtgggcagtgtgacccatggcctggccatacactcaggcaagagggccatggaaatttggcctattaaatggatgcacataggagcactgttctatggagatttgaggggtgcattaaagaagaacaagtgaatgcccatcagaagaactcccttccaggttcagaaagtgactggaattgacaagcagatatccccatgtactcccttgaagtggccacctgggcctttgaaatgagtggatatgggagtattgtaacagggcagagatgggctgaatgtagagatggtttttttgcaccttctcaggcacaaaatgccagaaagaactgttgtgtttctcaataagaaagccagagactgctgacggctttgggacagattctctggtgggaaggccctgaacatagctggcaagtgcgacaaatgctggtagccctggaggctacaaatgggtcttgacaggaatagacactggctatggagtggatgttgcttgcccagaagaagatgaaaattctctgagtgccataaaaaaccggaacagaagatattacatggatatagatggctaaccatcagtttttcagaccaaggaacacactgtacagcccataagaatagtccaacaatggacaaagagatatccacctagagtaatagtttgatagagcagtagagcaggcaattgaaacattgattgtgtaaaacagggggagataaaagcacaaagggctggctcacatgccttcctgtctgctcacactcaacatgagcaggactagagtgtttctgctagattttttttctttgtttttctggttgatctggggaacagggagttgggaggatgctggtatgactatgccattcttgccaagggacgagtacactggtataacaaatgtaagtttttctttcttccccaaatcacctaaaagaaatttatttttttctcccctggctgatgcagtggtcctaggaccaggactgcaattacaactgctggattagcaggggtgatttctaagcaaaaacctgtaactgtgttttgaaaccttatatcaaaattcccaaaggcatgatgggagtgggttgtgtcttcatgctatctagaaaaattggggctatcagtgaatgcagctatattgcctggtggtaaaaatagctcactagttctgcacctatgtaaccttacccggtctgaattggcgtggactgagaaggagctaattgctagacttgtattactacttgcaatgtagaccggcactgtggtggttctaatttctcttccaaaggtgaaaaggtttaggtattaatggagagaaggagaaatagtagctgagagtaaataaatgaataaatgagttattaattgagaaaaattcagtattacataacaactcaaaagagtctcagagcaagagatgacattgtctcttagcttaattatcccagatgccttaaagggtgaagctgcgtatttactgaggccactcctgctttcgagacctgacaagattgagaggaaacttgcaaccctgagtggcctcatcctggaagacattcaaacaatatgaaggatttgattaattgttaatgattgtgcataatatatatatttttgaagtaaaggcaccatggtggaaaaccagggagtggcctgtggtgttatgatatacactggttttagtccacagttcctggcttataactcctatatcccttgttacaatattttcttttttttatataatgttgggtatgttaggcctcaggagcaagcctctgaccttctcctgccttactttcactctaatgtttccccactttctaattgtgacgcttaagactctcacaggagagggttccatcctatatcctgagggaaggaatgctgatgtcatgaagctttcataaaaacccaagaggacagggttcagtgagcttccggatagctgaacatgtggcacttcctggagggtggcgcacccagggagggcatggaagctccgggccccttccttcataccttcccctatggttctcttcatctggatcctttgcaatatcctttataataaaccagtacatgtaagaaaaaaaaaaaaaatgtacttacagtttccttccttccttccttctccttccttccttccttccctccctccctccctccctccctccctccctccctccctccctccctcctttctttctttctttcttccttccttccttccttccttccttccttccttccttccttccttccttttctttcctctctctctttctgacaaactctcgcactgtcaccaggctggagtgcagtggcatgatcttggctcactgcaactcctacctcctgggttcaagctattctcctgcctcaacctcccaagtagctgtgactataggcacatgccaccaagcccagctaattttttttgtatttttagtagagacggggtttcaccatgttggccaggatggtctcatctcttgaccttgtgatccacctgcctcggcctcccaaagtgctgggattacaggcgtgagccaccatgcctggccaacctacagtattttttctaaggccatctctagctgcatacttaccacactaggtaaattttctgtaaaggcatatgccataaatcaggatttttttgttgtggttttttggtcaagattagtttctacatatcatccagtatttgttacgtctaatgagaggttgtatatatacatgtgaatgtttcaggaccatatggcaattattccatttaaaatattgctgtcctacttctcagaaaaaaggcaaggcataaattattgtttttactattttaaaaaatgtagcccttcatcagagcttagatctataggtataaattactaatgctcatccctttccagtggcaaaaaggagatatcaaattattttgagatttgagtaagaataaaattaataaatagcaagaggacaggtgtgtgaaagttttcatatgagtaacgctcgggttacttatttctttccttttaacaagaattatttagcccttgcctggctcttgctgcagtcaatttgagaggaaaggacatcttgccattgattttaattattcccagtcatcccattccttttttagtagattgaaactctcttgggctggttttctagctccacctacgtattggttggcactgtcttcatttaattttgcctgttattattccttcataatgcctttccctgaagtgacagaacatccttcacctgccaaggtcagcagtttgctacaggagatgacacttccaggatcatatgccaagtctatgtaagggcacaagcgaacggtggtggtaactaatagtcttaaagttatcttgtttattcttatttcagctttcctgctatattttttgcatactctctaaagtaatacatggtaattggaaaaatgtgagaagataaaaaagaaaatcagagagaatgagattgtgtattaattagttatcaccaaacaaaactccagactgtataaataccaaacaaactccagactgtataaaaagtaaaaacaggaaataatcatttcaaaatttcattggattaatgttttctattcctgcattcttccccctccttcttacctcttcctcctcatctttcttcttttccccatgtcaagtaatttccaagatggcccaggaataaagatatgcagttacaaaacattctagccctaactagtaagaacaaatattctctttctgtgaatagaaaggatagatggatctgtatatacacagacttgcatgtgagtttttagaatatgtacatcagttagattgtgttaaggcacaaagccatagagttatgccccacattaggaaatacttccaggaatgtgtattgcatgaataaataaatgaaccaatagcttactatgtgtcagattctttgctgtcctttaaatagatgatcttattgaatcttttccccatattaggaaatacttctaggaataagtattgcatgaataaatgatgaaccaatagcttactatgtgtcagattctttgctgtcctttaaatagatgatcttgttgaaaattcactgtgaaaagaatggggatctagcatgataaaaagatacttgttgactttatggcaggacacaagttacacattttgcagacttaagagaggctgtgtggcctgaattttgaagtagtacctactgctatagtagtgggcactcagattttgtagaattaggcttatcagaaatcctcagtttaattgtacattctatgcacttaatatttgagatttgttacattgtattggtgtctaatattttattcattccctatgagtgccagaaaaggagtgaaggtagagaatatttcatttgtcagtattccatgaaactactgattatgggaaattcatgaaagagcttacagtttaaaattctacaatggattaattaaatatatatatctgattacagctgaagttcaagtccctcagatcaatcagcagtattttcagagataagtagatttatttcttaattaattaattaatatttatgtgtctattaaatatggttcttcattgcacatactttgaaattttttttcttttttagagagagtgtcttgctctgtcacctaggctggagtgcagtggcgcaacctaggctcactgcaacctctgcctcccaggttcaagcaattctcatgcctcagcctccagaatagctgggattacaggcacgtgccaccatgcccagctaagttttatatttttagtagagatggggtttcactgtgttggccaggctggtctcaaactcgcaacttcaggtgatctgcccacctcggcctcccaaagtgctgggattgcaggcatgagccatcacacctggcccatactttgatatttttaaccatcaaattagtgaataaattactgaataaaacttaaccatatctcttccatgggtagggagactatggcatcacaaaggaacagtgttgttatatctttacaataggaaacattggacaaagatggaagagtaaggacaatgttatcattttcattgttccatcatcataatgtgccatgttgtgtatagacttctctacactgtgtggctgcttctttggaatacacagtcctaagcattgctgggattgtgaatgtcaaactactactatagatattttgtatctcagaacttaaacttgatgcagtaattattgtcttaatcattggttttacccttcctatcattgtgttggaataaggtctttcctgaagtgagtactataagcaatagtatagaaatacacaagagacaataaagtacgtgaggaaggctgggcacagtgggtcacacctgtaatcccagcactttgggaggctgaggcgggtagatcacctgaggtcaggagttcaagaccatcctgaccaacatggtgaaaccctgtctctactaaaaatacaaaaattagctgggtgtggtagcatgtgcctgtaatcccagctacttgggaggctgaggcaggagaatcacttgaatttgggaggtggaggttgcagtgagccaagattgtggcattgcactccagcttgggtaacagagtgagacattatgtatatatatatgtgtatataaatatatatgtatgtatgtgaggaggataatagttaatcctaacagattaacttggaatcattcaataagtagactgaactaaaattgggaagccattatttggtattaaattatgggcaccaggggtaaatgactgactaatagagcaggaaacaccagacagagaaaggaatgaaatacaaatgatggtcagtagggaggaggtggtcaaggaaaatgagttatgaacagaaagaactctatttacaggctgacactataaatgcttgtaaatgaaaaataaaattctaaggcctccagtgaactgaatggaaccctcatcttggccaagggtattccaaagttaacctgaaacactagttcaagccatgacgggaatgagtggtcagacatgcctcattataccctcgtcctgttggaattcagtcactactgaccagcattaacattaaaacagagaccttggccggatgcggtggctcacacctgtaatcccagcacccgcctcagcactttgggaggctgaggcgggtggatcacgaggtcaggagttcaagacctgcctggccaagatggtgaaaccccgtctctactaaaaatacaaaaattagccgggcatggtggtgggcacctgtaatcccagctactcgggaggctgaggcagagaattgcttgaacccaggaggcggaggttgcagtgagccaagatcgtgccactgcactccagcctgggtgacagagggagactctgtctcaaaaaaaaaaaaaaaaacagagtccttaagacaacgaagggagacactgtagcaataagagaccaacatagcagacagcaggccctgaagaaaactgaaatattttaccccaagatatatttctttgacatattttgaaatggccctgcaatggtgtctgttgtggggaaaatccatattctgtaaagaattcccttccttttccaagtctttttcctgatccaggagagaattaactaagaatttggcacctttttaagtctgatgagaaatatttacagtgtattctctctgaagcctcccatctggaggctttatctgcataataaaagccttgatctccacaacaaccgcttttcttaacccagacactcccttctattgattccacgcctttagataaactcttcaactgtgaatccacctatgacctgaaatcccactccccacaagccctcccaaccaagttgagttgtcccacctttccagaccaaaccaatatacatcttacatgtattgattgatgttttatgtctccttaaaatgtataaaaccaagctgtagctgaccaccttgggcacatgttctcaggactcctaaggttgtgtcacgggtatgtttttgaccttggcaaaataaacttctaaattgtttgggaactgtctcaaataccctttgggttactccctgaactatgccagaaaatcattgacattgtgaagggaaaatatcttgggtcccccaaatcactaagctaaagggaaaagttaaggttgggaacctcttagggaaacctgcctcccactctattcagtcacccctcttctcactgagataagcgcatatctgattgcctcctttggagaggctgatcacaaactcaaaagaatgcaaccatttgtctcttatctacttatgacctggaagccccctccaagcttccagttgtcctgcctttccagaccgaaatgatgttcatcttacatatgttgattgatgtctcatgtctccctgaaatgtataaatccaaactgctctgactgccttgggacatgtcatcagaacttcctgaggctgtcatgggctcacatcctcaaccatggcaaaataagctttctgaattaactgagacctgtctcataatttgggggttcatgttttggtaaccacagagggattctaagtagaggtgcccctgacctttgacaaatctccttttggtgtttggtatcagcttgagctatctttatggctcaaaccaataggataatttgctgaggtctggaagcaccctctccagagaatccctgatcttccaaaatttggttgagatctacagtttattttggtacgtaactcctttttttgaattttacttgcttccaacccaaggaaggcaagttttccctgcttccataatgatggaaggcagataactcctttatggagtttgagctcacttccaacagggaagatgagtttttgttgttgtttgtttatttgttttgagacagagtcttgctctgtcacccaggctggagtgcagtggcacgatctcagctcactgcaatctctgcctcctgggttcaagtgattctcctacctcagcctcctgagtagctgggactataggcgttcaccaccatgcccagctaattttttatttttagtagagacagggtttcaacatgttggttaggctggtcttgaactactaacctcaagtgatctgcctgccctggcctcccaaaatgctggggttaccggtgtgagccaccgcacccagcctgatgagatcccctccgctgccccctacttctaggatggtagagagcagccttcagcctgaaatccatccctaggcaagtaaatgatgtcaggcctctgagcccaagctaagccatcgtatcccctgtgacttgcacatacacatcccggtggccggttcctgccttaactgatgacattccaccacaaaagaagtgaaaatggcctgtttctgccttaactgatgacattgtcttgtgaaattccttatcctggctcaaaagctcccctactgagcaccttgtgatcccccactctgcccgccagcgaacaacccccctttgactgtaattttcctttatctacccaaatcctataaaacggtcccacccttatctcccttcgctgactctcttttcagactcagcccgcctgcacccaggtgaaataaacagccatgttgctcacacaaagcctgtttggtggtctcttcacacggatgcacatgaaaaatgaagtggggtttgtcttggttaaagttaagatttccaaccgcctgatcttaatttctccttaccattagagtgcttggtaatcatgtaagttgtgcaattgtttgttttgcttaacttttgttttgttattgttttttgtttctggtttttgttgttgtttcagtctttttctcattgggtttgatcaactctatccaactagatcaaatccaaaggaagttccaaattatggaacaaggcctctgaagtggctaaattcccagaaaaacgacgacaacaacaacagcaacaacaactacaaaaacggtggtgtggtagcagagaaatataccagcaaaaggaaaaaaaagaggaaaggctttgattttgactactaataggctttatttacatagcaaggtggcctttttgctaatcaggccaaactgaaagagcaatggctattacttctgaaatagcagcaatttgtcctagctgaaatatggtaatgatatttaaaaacatattttttaaaggggctcagtggctagtcagcttaattaaaagctaacatccaagatgtgtgtgtgtatgtgtgcatatgtgtgtgtttgtatttaaaagaccctcatgcttttgtttttgcttttctcctaggaccttgtctctttttcgagcaaaagttttttcttctcagttgactgaattctgttttcttcacttgtttgtttctgctctctctcctttctcttgcaccctctgctgcatggggaacctaaaatagttcgtaatagcctggggttccttaaagaaaacagtgaaggcaccagactcccttcggaggagaaacctgtttttccttatggaaccccaagaatgcaaacagacaaggtcctctcagctcttaaactgcttactttttttcactcacgtccgtgtgaagagaccaccaaacaggctttgtgtgagcaacaaggctgtttatttcacctgggtgcaggcgggctgagtccgaaaagagtcagcgaaggcagataggggtggggccgttttataagatttgggtaggtaaaggaaaaagggaggttgttctctggcgggcaggggtgggggtcacaaagtgctcagcgggggagcttttgagccaggaggagccaggagaaggaatttcacaaggtaatgtcatcagttaaggcaggaacaggccattttcacttcttttgtggtggaatgtcatcagttaaggcaggaaccagccatctggatgtgtatgtgcaggtcacaggggatatgatgtcttagcttgggctcagaggcctgacacttttgtattgtgttacctggttttttgtttttgtttttggctaacatagttattgcaacagagtttgctcttgggtttttaaggaagagtgtgttttagacactagaaatgtctttgcttaaaaaaaatttttctaagtgcacttaaaaaaacttaaaaaagtatcatgtggtctaaccttattataattctcccattctggagaccctggaatcagtgtgggctctgcccacagctcagggatccagttaaaagataggtagttcctatctaaataaaactggtctccttatccaatcttacgatagatttctgtaattttatgtttgatttggcatctatctttaatctccctctagcatcaccagactttttctctcagtaccttgtgatgtaaattttgctatttgcatttcacctgagtcgtttcctttaatttgcaaatttaagcgtgtttacctgacaactgcctagggttgtgaaacagattatcaaaaatctgaaagtctaagatagggaaaaaaaggtttttataaatctataagatgtaatttatcagcatgcctaatatgtctatgtatttatatgttatgtacagaatgtttcactactcaaaatagataaaagagctctaattaattggcttaagaaaacaaaaatgcttgaatcaaatactttattggaaaaaagaaaagactagtcaaatgcttattcaagtttatgtaacttaagtaaaatctttaataaataagctagctttaaaattattggtaaagtaatattagaaatgtcttaagaattgccagcatacatttttgttttgtatttattaatcaagcaatttcatacttatccctgtcaaatgctatgaggtgtcaaaatttggcatagtggttacaaaactataaaaccagcccaagaaaatgatctttccctgtgtaatctttaaataaattagagattgatattggtgtaataagctacatcattttattttatttatttatttatttgtgtttttttgagacagtcttgctctgtcaccgaggctggagtgcagtggcacgatctcggctcactgcaacctccacctcccaagttcaagtgattctcctgcctcagcctgagcctcctgcctcagtccggagtagctgggactacaggcgcatgccaccacacggagctaattttttgtagttttagtagagatggggtttcaccttgttagccagggtgatctcaatatccttacttcgtgatccgcccacctcggtcttccaaagtgctaggattacagtcatgaaccaccatgccctgcctttatttactttttttgagactgagtctcactctgtcaccgaggctgtagtgcagtggcatgatctcagctcactgcaacctctgcctcttgggttcaagtgattctcatgcctcagcctcccaagtagctgggattacaggcatgtgccgccgttcccagataatttttgtattttttgtatagacagggtttcgccatgttagccaggctggactcaaactcctgggctcatatgatttgcccgcttcagcctcccaaagtgctgggattataagcaggagccaccaagtcctgccaacatcttgaatttagtaagattactgtgacttctaatcttgtggcttttgtcggtctagtccacaggcagtaaggtttgttttgggaaaggactgttatcatctttctttcaaagctaaactataaaataagttcttcccaaagttagttcaaacttttatcaaagccaatttaaaagcctatgtaaaaaaataattattcttgctgagctgtatacaaataatttggccaagtatcataaagcaaatgaatcctatcatgatttgtcttgagtaaaaattaaaaactggagagagaataactgtgtttcaaaacctatactatacctgttgttagattctaggtcttgcctaatgtttttcaatttttattattttctacagtttggaccaaattctaatttttcttggctacaagtcttcaaaataatgttctcatttttttcttcttttttttccccatttttcctaatttggagtcactgaaaactaagctgtgctttcgtaaagccctgtgaactgaagctagacaactcgaacttcagaagaaaataacagcaacctatttacatacataagccactttcctacctgcctccaatgtaaggatttcagagtaatgtggcctatatcaattttccaggattgttcttttgcttattgttgtttttctcccttcctccccctattttatctttaaaggatatgaagcttcacaacttctaaaaaatgagctttcctaataactcaggacctatctgcctaggaataacccattgtacccatgagaaattagaggaaatctgagatcagagactcattttcttttaacatgttttctccaaagattttaaaaaagaaaaggggggaaatgtgagagaaaaatatcctgcccccccaaggttactgaactaaagggaaaagtcaagctgggaactgcttagggcaaacttgcctcccattctattcaaagtcaccccttgctcactgagataaatgcaaatctgattgtctcctttggagaggctaattagaaactcagaagaatgcaaccatttgtctcttatctatgtatgacccggaagtcccctccaagcttccagttgtcctgcctttccagaatgaaacaatgttcatcttacctatgttgattgatgtctcatgtctccctgaaatgtataaaaccaaactgtgctctgaccatcttgggcacatgtcatcaggacctcctgagactgtgtcacgggagcaagtcctcagcactggcaaacttactaaattgactgagacctgtcttagatttttggggttcacaacattcattagctattgggggtctaggactgaaatttaaaggcatagatgaagtctgacagatccaatctgatgttaactttgggattttctttagttaccactcagtgccccagtcctccttaaaatactttacacctccaagtctttttccttccataaaagccaattgtttctctaacactaggtctctgccttgctgttacctgccttcagaacctggggtcttcccttcatagttagggttcccaccagctaagaattcacggcctggatctctgcatattgcctatgctcagattgccttgctgccatgtcccacctatcctgtcacacttttctcacctggagtttgatggtttccttgtcactcttcctcccttgcagtgtgctctactttgcttctctgggcagacccttgcataatcctgggtctgcccctatatgcctctagtaggagttgatgctgggcttgtattttggatagacccaatggtaaataaaccctgactgtcattcattcatctgtcaaatatcattatgctctaccatgtattaagcattatgctaggcacttgagatataatgagagaaataaccatggaggaacacaggaactctcatacattgctgcaatttggcagtatattgtaaagttgaacaggtacatgccctactctgcagctaattaatgtctcggtatctacctataaagactcttgtttctcctcatttacttcatttgcttttctttcatttacaacatattatgtaggacatacttttttttttttttttttttttttttgagatggagtctctctctgtccctcaggctggagtgcagtggagcaatctgggcttactgtaaccgctacctcctgagctcaagtaaggtggaggttgcagtgagcccagatcctcctgcctcagccttctgagtagctgggattataggcacatgccaccaagcccggctccggtacatgacttcaggtgatcctgacctcagatgacccacccacctcggcctcccaaagtgctgggattacaggcatgagtcactgtgtctggctgagcatgcaaaatttgtaatcggtagacattgtttataggcatgtttcataattataaaatgaattaaaaatcagtcacataaatatatgggctttttcaaaataacccaacatggaaaccttgatatccttccctagatctatggcagtctttgtagtctccatgacattgcacagcttgggttcagaaatgactctctagaaaaactgaaacaccacacctctgtagataatgatgtgcagctggggctcagccacttgtgttagtgaagttcctttcacaccaaagatactcaccccacttccatattatatccaatcatagtatttcaacttctgtcaaaattcccagtctccaactatggtgcagcagatcctttcaaatgtaaatacaatagcataaacttatatactgacaattctgtaacatacagaatttcattctgtatgattctatttaatagagtttcaaaatattcatatggatgaccataaaagaaagtaagattaaagatgtgctctttatgaaaaggtgtaacccacatttcaatcagggatactttataatctttaaaaaacacaccattgaccaggtgcggtgactcatgcctgtaatcccagcactgtgggaggctgaggcaggtgaatcacctgaggtcaggagttcaagaccagcctggccaacatggtgaaaccccatctccactaaaaatacaaaaatgctagccaggcatggtggcaggtgcctgtaattccagctaccagggaggctgaggcaggagaatcacttgaacctaggaggcggaggctgcagtgagccaagattgcaccactgcactccaggctgggtgacagagtgagactctgtctcaaaacaaacaatcaaacagccacaccatcggccaggcgcagtggctcatgcctgtaatcccagtactttggaggttgaggtgggcagatcccttgaggccaggagtttgagatcagcctgggcaacatggtgaaacccagtctctactgaaaatacaaaaattagccgggcatgatggtgcatgcctgtaacccagctactagggaggctgaggcacaagaatcacttgaacctgggaagtggaggttgcactgagccgaacttgcgccactgcactccagtctgggcaacagagatagacgctgtctcaaaaaaacccaaaaaaccaaaaacaaacaaacatacaaacaaaaaacaccattgtttttatttttattttttccctatttactacttccacaggaaaattgtttgatttttgctctattttaagccaaacttcatatgcagggtaaggctgaggcaaaacaagtgagaaagtggttgtagataaatgtaaacgaatgaccatgagatgaccctttcagaacttgtgcaacacgtatgtcaccagccccattagcctgtgttaggaataacgttcaaaatcctaaggaaattgaacactcgaacaaaggattcttagcaaagcaattttacttctgcgcacaggggtgcctccttggccagttacatgagagcacacctgaacaaaggggcaggggaacctttatttctgttgcaagtcctgccccgtacgctttttttattggccagggtcgggtcgtacaatttaaactaatctcggttggctaagcatttgattttttttagatagggtgggcacgtacaagaaagtggagaggaaggctggacgcggtggctcacgcctgtaatcccagcactttgggaggccgaggcgggcagaacacgaggtcaggagattgagaccaccctggctaacacggtgaaacctcgtctctactaaaaatacaaaaaaattagtcgggcgcctgtagtcccagctactagggaggcggaggcaggagaatgacgtgaacccaggaggcggagcttgcagcgagccaagattgcgccactgcactctagcctgggggacagagggagactccgtctaaaaaaaaaaaaaaaaaaaaaaaaaaaaaaaaaaaggaagtggagaggaaggggaagggttgtctgcaatgagctagaaagttagtcttttttttttttttaaataaggaaaggaatgcgaggtggtactgataatgcctggtactgtagcgtgcctgggcattaaaggagaaaaacggaaaaacggaaaaacggcgggggtactatgaattaaagaataaaagattgatcagattatttgaagagaaaccgcatcatatcccacacctgtcactacataatgaggttatgcttcatttttatatgtatataattatgaaaaaagactctgtctgtttgcttaccagatgttagcatgtatttttctacaacattgtttggagcgtttcctagagtactgcttggctttttgttcaggagccttgctgcagctgggtccttccttgcagccttcccaccctgctgactgacaggatgctacctttattgctgctgatgtttatcagactgatactctgcctctaattgcaactggcattgtctctccagctcacaggaggggaaactgttcttgtaattcttcgtaatacagttgaggcccggctaggaccttggccaggcttgggagtcatagggtttgcaaactcaaatgtcaacagaagtctggctggtaatggaagcgtgaaggctgcatagtttaagaaatgtgggcatgccatttggctttaatgttaggaaataacagccagtggccaggcgcagtggctcacgactgtaaccccagcgttttgggaggccgagatgggcggatcacgaagtcaggagatcgagatcatcctggctaacatggtgaaaccccgtctctactaaaaatacaaaaaaattagctgggcatggtggcaggcacctgtagtcccagctactcgggaggctgaggcaggagaatggcgtggacccgggaggcggagcttgcagtgagctgagatcacgccactgcactccagcctaggcgacagagcgaggctccgtctcaaaaaaaaaaaaaaaaaaaagaaaagaaaagaaaagaaaagaaataacagccagtatgagtgaactgacgacgacatactgcatttaaagggagaagctgctattcaaagccaactgattgttgatatatggaaacagggcttagtttttccagttacgattttgcaaaagaactctgcaatttatattttttaagggaaatattcttatttttcaatactggcaactaattctttttttttttttaaagaaagtgctgtggccaaaccaaatatttctgtgggcctccatagaactatgaaacactaatctatgaccattgactaacaactgctaccggaagtagttacttgctactcccaggactcacagtccaactatcttttagattccctgcatagcaaccggcagacctccatgtagcatgagctgacacagacagacatacagacatacacacacacacatgcacacgcacatttacagagtgcatatgaatgaaaatcccatttatatcaggagaaaaacccacatcctccccaatattggtgttgggctccacagactactcaaagccatcactgtggtttgcccatttagtctcaagtaacactttatgtggaagagaaatgttacattatagtccatatgccactgcgtcaaatccaatgcactttgcattcaatcttgccttcaggatgaggtaaagaaaagttgctactgtatgcatggcataatctcatctcctatctcctggaagcaaatggttaaacaaaaattataaacacaacttccaagaacaaaatagtaattttcagtagcaagtagcctgaattcagatttaagataaactatgtctaactctgtggaggttcagcctggctaataaatcaaatttacattaaggtcagggctctggtgggactattcccttatattcaggagtgtcttcaagaataatggaaagctacttgagtacaagagtaaaagggcccactcaatttccacatcagaatgcgggaaaaccacatgccatattctcattggaaacttctcctgcttcaaaatttaaagttcattctgcaccagataatccatttgattaaaagaaaacaacttctgagggctaacctgttaaataagcccacatccaaagtcatcttaaaggtgactatcagagcaataaaatgaaacagtaaccctgcttgaaggcaaaacaaatttgaagaacaattcagccagaggtagagtcttgaagtctaacaccagctgtaagaaatgaacactatgctggagaagaggtgagagatcaggctaccttgtttttgagtaacctagcatgtagatatctattgtgcaggaagatgtatcaggtaccttggaattacagaactaatgtctatggtgctgaatttatgctaagaaatattctgataatttaattttcccattaagaaaaagtttgctggtcaacctgaaaaatatggtctatttggccagattgacaatatttctcattataaattaacaaataagttttctggttatatactttagttacacaaatatattgtgtaattgtatgatatgattacattgagagggtctaaatattttatatacttaagaaatattaggtaagttgattttaaataggcattacagatggcaacataagtaaattaaaatatcaccttatacagtcaactcatttttaacttttctttattcatgcactggaaacatgcatttttatttttatttctcaaactattttttaagattaaatgaattcatttttctttacctgcagaaaattgccctgtcattaagaaagaggaagaagagaacactcatatttattgacagcattgtttggcctcttatatatataaaatgtcatttattttgcacaataaccctggggaaaaaaggtattctccctgtgtaataaaaataggttgaggcatgtttagtaaaacatgccctaggtcacacagctagtaaattgtgggctaagatgactcttttattctttatgatttttttattggcacattgtagcctaaaattctaaaagaacatataatcttgtgtgctactaaaaattttaatctgctctacccaaggtttaagtagtatttgaatgagccagattgggagaggccgtgactcagtcagagtcagactgtcagacttgcagtgttgtttggaaagatgggtttctgagatgcgcattaggccagggacatcaggcttcaagtaaatctaaaatctaggagattattctttgtagggtagaggagacgcaaaggacataggtttaaaataagcatattaacctgtgcagctgcattaatgagtgcggcttcaaaagaatctcttcagtaacagagaaaataatgactatattcatacatagtaggccattgacagaagacccaggaataagatcagccatatattgtatctgaaatatggctaaagtgtaattaaatatttaatattaaactaaactcatatagaactgggaaataagaccatcaaattctcagttattgttatctctgaaagtggctttgtttagttgataatttgactagggttagaattataggtccaaatatatacatatatatatatacacacacacacgtatatatatatatatatatataccgtatatatatatatatatatatatatatatatatatacactttttttccaactcaatattttgctcaagtgtttaattgcaagtagtatgctgatgaaaaatctgttgttaatcttgttcttattttcctgtaaggaatctttcttttctctctagcagtgtcagaaatttcctttttatacttagtattctaagatttcaccatcttgtacctgtctttttaattttgcatggctttcactgacccattatgtagtttcatgtctttataaagttctggaaaattttaggctattacctcctgaaatattttttccctacattctgtctaaatctattgaaaagagttacgagtgggtaggtaatttggtgactggtctcttggtatgagagcatctcattccttttggtgtcaccaattctctaatacactgccctatttctctgcaataagaactgtattcatctttcctttgtggagatagatattgctatttgtcttataggagggagaggagagagatactcaggggctgacctgtctgggttctccctttgtggggctccaactaatcatcctgccaatggcttttgggtacccctcctgctcctggatttcattccttccaggcgtggagcatttatcttgttggtctcacctcctgggttagaacttttctgaaggaatcatgggctgtgacctctttcttttctgctcatatttttcaaagactaattattatttctgtcgttttcaccatagatatttttatttatttaaaaaataaattttccttaatttttatgaatttagtgtaagaggagggattatattaaatgctcaccattttaaaattagaagtctgtcttctatctttccttcactaatatgtgtgttttgtacttagtcatatggtcaaatacttgtacataaaattatctgaaaaagcaaatgaaaaattaactagatttccccgtcgtatttgcatgtattccttacaaacttacctcagtcttcattttttcctgctctgtccattttcatccaaaacatacacatatacatcatacagtcaagataagcatgcatatatcacaggtatctttaacacagtttgaagatgtaacccttcattaaatgatgatggagaaaaaataaaggtaaacttagagggtatagttgagagacagtattaaaacaattgacttttaaccttattggtcttgattatggaacagagatgggtgaatcgttcatttagatttttttttttttttttgagacagagtttcactcttgttgcccaggctggagtgcaatggcacaatctcagctcactgcaacctccgcctccctggttcaagtgattatcttacctcagcctcctgagtagctgggattacaggcatgcaccaccacgcccaactaatttttgtatttttagtagggacggggtttcaccatgttggccaggatggtctcaatctcttgacctcgtgatccacctgccttggcctcccaaagttctgggattacaggtgtgagccactgcacctggcctcatttagattttatgttatttatttatagcttgataatattttgtcttttaatttttattattgtctaaatattcagatttagaggaaatattattttcttcaggcaaaataacagtcctgagaggcaaagtttttttgcttcttttttttgagatgcagtttcactcttgtcatccaggctggagtgcaacggtgcgatctcggctcactgcaacctttacctcctggattcaagcgattctcctacctaggctcccaagtagctgggactacaggcacacaccaccatgcctggctaatgttttgttttgtttttttttttagtagagatggggttcgagaccatgttggccaggctggtctcgaactcctgacctcaggtgatccacccgcctcagcctcccaaagtgctgggattacaggcatgagccgccacacccagcctgcttttaaaaatattatttttaagttattagtagaatggacttattgaaatatgtattttttaactgaaggtacttggcatagtaagtttaactatgtttaactctgttgatttgcttttacattttgtgcaatcataagtgtccttcagttcttaaatatccacagcaaatcaaatattaactctgtgcatgtttttgagtttttattaagtagtgtttatatcattgtacctattcttatagctattgcctacatccaagtaggcattttgtttagttctttttctttagtctctcgaaataatgaaaagtgaaaatttctatcatttgattgactgttttaagtctttaagtatattacactttgggcaaaatgcctactactgataaagacagcaaagtttttacagatgtataattaaaaactgacaatgcagtataatggagaacacacagaaagttccctttgtagtagtaaaaatgttggtatgcatagaggtgggaacttcaatgtgctagtgtggagggagtggtgtggaagtggtatgccataagtgtggaaaggtaggtaggaaccggatctttcctggccttataggttataataaggatattagatctttttctcaagccaataaggaattttaaaataactttaaagaggggaatggcatgattagtctatagttttaaaaagtcactctgccttcattatgggaaatacattgggggcagagggtatacaaatgcacatagggaggaggatgtgcattgaaacatatacatttgtgggcacaaaataaatattttgggatattggcagattggctaactctattctcttcagacttcttttcaatattttctgaaacgtcaccatggacaaataataattaataattaataattcattaattaatcattaatacaggaggttccaagatggccgaataggaacagctccagactgcagctcccagaagatgggttatttctgcattttcaactgaggtaccaggttcatctcaatggggcttgtcagacagcgggtgcagcccagggtgcagggcggggcatcgcctcacccaggaagcgcaaggggtcagggaattccccttcctagcaaagagaagccatgacagacagtacctggaaaatcaggacactcccaccctaatactgtgcttttccaatggccttggcaaacagcacaccaggagattatatcctgcacctggcttggagggtcccttgctcactgctagcacagcagtctgagatcaaactgcaaggcggcagcaaggctgggggaggggcgtccgccattgctgaagcttgagtaggtaaacaaagcggccgggaagctcgaactgggtggagcctaccacagctcaaggaggcctgcctgcctctgtatactctacctctgcgggcagggcatagctgaacaaaaggcagcagaaacttctgcagacttaaatgtccctatctgacagttttgaagagagtagtgcttctcccagcatggagtttgagatctgagaatggacagactgcctcctcaaatgggtccccgacctccaagtagcctaactgggagactcctcccagtatgggctgactgacacctcatacagccaggtatccctctgagatgaagcttccagaggaaggatcaggcagcaacatttgccattctgcaatatttgctgttctgcagcctctgctgggatacccaggcaaacagggtctggaatggacctccagcaaattccaacagacctgcagctgagggtcctgactgttagaaggaaaactaacaaacagaaaggacatccacaccaaaaccccatctgtaggtcaccatgatcaaagaccaaaggtagataaagccacaaagatggggagaaaccagagcagaaaagctgaaaattctaaaaatcagagcacctcttctccaaaggaatgcagctcctcaccagcaatagaataaaactggatggagaatgactttgacgagttgaaagaagacggcttcagacgattggtaataacaaacttctccaagctacaggaggatgttcaaacccattgcaaagaagctaaaaaccttgaaaaaagactagacaaatggctaactagaataaacagtgtagagaagtccttaaaggacctgatggagctgaaaaccatggcacgagaagtatgtgacgcatgcacaagcttcagtagccgattcgatcaactggaagaaggggtatcagtgattgaagatcaaatgaatgaaatgcagtgagaagagaagtttagagaaaaaagagtaaaaagaaatgaacaaagcctccaagaaatatgggattatgtgaaaagaccaaatctacgtctgaatggtgtacctgaaagtgacggggagaatggaaccaagttggaaaacactctgcaggatattatccaggagaatttccccaacctagcaaggcaagccaacattcaaattcaggaaatacagagaatgtcacagagatactcctcaagaagagcaactccaagacacataattgtcagattcaccaaaatagaaatgaaggaaaaaatgttaagggcaggcagagagaaagattgggttacccacaaagggaagcccatcagactaacagcggatctctcagcagaatctctataagccagaagagagtgggggccaatattcaacattcttaaagaaaagaattttcagcctagaatttcatatccagccaaactaagcttcgtaagtggaatggcacaatctcatgcgccaaacaaatgctgacagattttgtcaccaccaggcctgccttgcaagagctcctgcaggaagcactaaacatggaaaggaacaactggtaccagtcactgcaaaaacatgccaaattgtaaagaccattgaggctaggaagaaactgcatcaactaacaagcaaaataaccagctaacatcatgacaggatccaattcacacataacaatattaaccttaaatgtaaatgggctaaatgctccaatgaaaagacacagactggcaaattggataaagagtcaagacccatcagtgttctgtattcagtaaacccatctcacatgcagagacacacataggctcaaaataaaaggatggaggaagatctgccaagcaaatggaaaacaaaaaaaggcaggggttgcaatcctagtctctgataaaacagactttaaaccaacaaagatcaaaagagacaaagaaggccattacgtattggtaaagggatcaattcaacaagaagagctaactatcctaaatatatatgcacccaatataggagcacccagattcacaaagcaagtccttagagaactacaaagagacttagactcccacacaataataaagggagactttaacactccactgtcaacattagacagatcgagacagaaagttaacaaggatatccaggaattgaactcagctctgcaccaagcagacctaatagacatctacagaattctccaccccaaatcaacagaatatacattcttctcagcaccacatcccacttattccaaaactgatcacatagttggaagtaaagcactccttagcaaatgtaaaagaacagaaattataacaaactgtctctcagaccacagttcaatcaaactagaactcaggattaagaaactcactcaaaaccgctcaactgcacggaaactgaacaacctgctcctgaatgactactgggtacataacgaaatgaaggcagaaataaagatgttctttgaaaccagtgagaacaaagacacaacataccagaatctctgggacacatttaaagcagtgtgtagagggaaatttatagcactaaatgcccataagagaaagcaggaaagatccaaaattgacaccctaacatcacagttaaaagaactagaaaagcaagagcaaacatattcaaaagttagcagaaggcaagaaataactaagatcagagcagaactgaaggagctagagacacaaaaaaacccttcaaaaaatcaatgaatccaggagctggttttttgagaagatcaacaaaattgatagactgctagtaagattaataaagaagaaaggggagaagaatcaaatagatgcaataaaaaatgagaaagaggatatcaccaccaatcccacagaaatacaaactaccatcagagaatactataaacacctctatgcaaataaactagaaaatctggaagaaatgtataagttcctggacacatacgccctcccaagactaaaccagtaacaagttgaatccctgaatacaccaataaaaggctctgaaattgaggcaataattaatagcttaccaaccaagaaaaatccaggaccacatggattcacagccaaattctaccagaggtacaaagaggagatggtactattccttctgaaactttcccaatcaatagaaaaagagggaatcctccctaattcattttatgaggccaacatcatcctgataccaaagcctggcagagacacaacaaaaaaagagaattttagaccaatatccctgatgaacatcgatgcaaaaatcctcaataaaatactggcaaacccaatccagcagcacatcaaaaagcttatccaccatgatcaagtgggcttcatccctgggatgcaaggctggttcaacataagcaaatcaataaatgtaatccatcatattaacagaaccaaagacaacaaccacatgattatctcaatagatgcagaaaaggcctttgacaaaattcaacagcccttcatgctaaaaactctcaataaactaggtattgatgacaagtatctcaaaataataagagctatttatgacaaatccacagccactatcacactgaatgggcaaaaactggaagcattccctttgaaaatcagcacaagacagggatgcctccctcaccactcctattaaacatatcattggaagttctggccagggcaatcaggcaagagaaagaaataaagagtattcaattagacaaagaggaagtcaaattgtccctgtttgcagatgacatgatcatatatttagaaaaccccatcatctcagcccaaaatctctttaagcgataagcaacttcagcaaattctcgggttacaaattcaatgtgcaaaaatcacaaggattcctatacaccaataatagacaaacagagaggcaagtcatgagtgaactcccattcacaattgcttcaaagacaataaaataccaaggaatccaacttacaagggatgtgaaggacctcttcaaggagaactacaaaccactgttcaacgaaataaaagaggacacaaacaaatggaagaaaattccatgctcatggataggaagaatcaatattttgaaaatggccatactgcccaaggtaatttatagattcaatgccatccccatcaagctaccaatgactttcttcacagaattggaaaaacctactttaaagttcatgtggaaccaaaaaagagcccacattgccaagtcagtcctaagccaaaagaacaaagctggaggcatcatactacctgacttcaaactatactacaaggctacagtaaccaaaacagcatggtactggtaccaaaacagagatatagaccaatggaacagaatagagcccccggaaataataccacacatctagaaccatctgatctttgacaaacctgacaaaaacaagaaatggggaagggattccctatttaataaatggtgctgggaaaactggctagccatatgtagaaagctgaaactggatcccttccttatactttatacaaaaattaattcaagatggattaaagacttaaatgttagacctaaaaccataaaaaccctagaagaaaacctaggcaataccattcaggacataggcatgggcaatgacttcatgattaaagcaccaaaagcaagggcaacaaaagccaaaattgacaaatgggatctaattaaactaaagggcttctgcacagcaaaagaaactaccatcagagtgaacaggcaacctacagaatgggaggaaatttttgcaatctacccatctgacaaagggctaatatccagaatctacaaagaacttaaacaaatttacaagaaaaaaaacaactccatcaaaaaatgggcaaaggatatgaacagacaattctcaaaagaagacatttatgcagccaacggacacatgaaaaagtgctcatcgtcactggccatcagagaaatggaaatcaaaaccacaatgagataccatctcacaccagttagaacagcgatcattaaaaagtcaagaaacaagaggtgctggagaggatgtggagaaataggaatgcttttacactattggtgggagtgtaaactagttcagtcattgtggaagacagtgtggtgattcctcagggatctagaactagaaataccatttgacccagccatcccattactgggcatatacgtaaaggaatataaatcatgctgctataaggacacatgcacaagtttgtttattatggcactattcacaatagcaaagacttggaaccaacccaaatgtccatcaatgatagactggattaagaaaatgtggcacatatacagcatggaatactatgcagccataaaaaaggatgagttcatgtcctttgtaggtacacggatgaagctggaaaccatcattctgagcaaactatcgcaaggagagaaaaccaaacaccgcatgttctcactcataggtgggaattgaacaatgagaacagctggacacagggcggggagcatcacacattggggcctgtcgtggggttggggaagcagggagggatagcattaggagagatacctaatgtaaacgatgaattaacaggtgcagcacaccaacatggcacttgtatacatatgtaacaacctgcccgttgtgcaaatgtaccctagaacttaaagtataaaaaaaaaaaaaagaacaagaactccaataacaggccttgaaaaactaagcgtgaaatccaggttgtggaacgtttgaccccaggaagaatgtatttcatctgtgtgtagttcatctgtattcttgtggtaatcaagcagacaccagctagaccactagttggcccactgctcaagacagtcgtcaagaccagacatactaccgcacacgtagtcaactcctgtgcttcccataaaaaccgtctagctagcctgagaaacttgagatgatctttgtgacatgagtccaccatctcctctggttgtcaactcctgaataaacccatttttctccctcaaaaaacattaataattattaataataaattaacaataaatcattaacaataattaataattaataataattaataataaaaattaataaaaataaaataaaataaaagtattaaaaactctaataaaatataatacaatataatatataatacaatacaacataatatgtgttatggctaaggaaatttcagattaggaaggacacctaatttagactaaaagagaacagcttcctagagaaggtgaaagatgagttaagtgctgatagctggatagttcagtcagaccaagaaagaatggcttttctgaatcaaagaagaacatttatgtggatatcctgataaaacggaaaacagatcagagtacaaagtataccattaccagggatgtggctgaagagataggccgacaagatattagatattatgctaaaaatccaggatttatcctgaaatggtaaatggtaattgaaagatttttagcaagacagtgacatgatgaaactggtatttcaaaatgaacatgctagcaagaggtgggataatgtactggatgagaataagacgggaagcagagaggcccattaggaatttgattcatttattcactaatggtgataccaaatgcttagtatgtaacaactattgagccaggtgttagggacacagtggtcaacaaaaaagagggccactgctttccttcaaaggtttaaagtctagcacatcaataaaataatacagggaggtaatccagcgcttgaccattctctccctttaaaaattatgtgtgttactttattataatttaaaaatacagatgaataagaagaatgtgaacaaaatcagacatccactcaacctctatggaatgttaacattttattgtgtgtacatacttctagatgtttaaaaatatagtatgtgtatatattgtatatcatacaattatatgaataaatcagactgttctcaattggtttatgatctagtttcctcttaacaacacatggtgatctttccataaccataaatctatttatccatattattttttatgaggggatgatgttctactgcattttcggacattttaggtaggactattcaaaacaatgttagaatgaatattcttataggcaagttttaaatttcatttcattagattaaattcttagaagtggaataaaagaaaatgcacattttaaaggcctttgataatgccccaaaccctcctttataatcttttcttctggcttccataccatactttgttaggttttttttttttttttaactacatcagcaactcatacacagtcttcttcattagttcattgctgcacattgaaatcatctggggatttttaaaaattactgatgcctggctcccacccttagacataccaatttcattggtatgtggtacaatctgggaattggaatttttagaagtgcctcaagtgattcttacttgcagcaaaagatagaaaccactgtattcttttattttccctgtttactacagaaatttaagttccatcctagatctgcatcttaccttttttcacatgctcttcatatgtaatcataatttcacctcttccactctaaactctatgaatataattaaaaactcgtatcttgcacttttcctgaggtccagttccactttgttcattgcctataggaaagtgtgcactaatgctaaatatagaattagctctcaaacttggtgtatctcaaactgaattaagaggtctcccttactcttgataaacagaaaactaaacacatgtttaaaaaaacagcaacacctgtggggaaagatattttctacctttcagttggttgcaaagctcttgtcttgattctttctctaaaacatattttaaatcagtttcccctaccctttctattaccattaccacaacctctaccctcagagtagtaccactgtgacaatacttatctgaatatctgtcttgggagcactggcctgtcagagtagtttgcctgcaatctcacttgcatgaagatagcacctagtgaataccagtagatatgacattagggactgaaatcaaggtggaattaaaaatttcaacacatgtaagtaagagtgtgtgtgtgtgggaggaagtgggataatgtaggagaagggacagtgatcatttccaactacttgaagatggccactcttgggccaggaactcagcccagggttggagaatgttgagatacatcgggctcatcccgattgatttcaggctgcaaaggtcactttgagaattaattgacccaataatggaggaacaactataacgttccaggagaaagaaggctaaaaagcaaaactattttatttgtgttataaatatctgaatttttaaaaaatttgaactccttacccaggcaagtctgccataatttcaaccaaggaatactgacaaatctagaaattgagagatttataagctactgaatctaaaatatggaagcagctaagctgacatgactggggaaagtgaggatcctttaatctctgactgtgagggtgactgtccttgacatgctgtgaagagtagctataaaccatcacttcttgtttctcagatctcaaactattgatccactcagctaaaataaaagctccattgagcagaggccttgattgtacaattaattattctccagcagctctgagagtgtgagatatatggtagccatacaaaaaatattgagttaataatttctcatactggggccaaaacccctgtgaccatagtagcaatgtagtagggtgttcaagtgtgttacttctttagaattttagaaatgtaatttaagaattttttttttttttttttttgagactgaatctcactttgtttcccaggctggagtgcggtggctcgattctggctcactgcaacctccgtctcctgggttcaagtgatttgcctgcctcagcctcccgagtagttgggattacaggcgtgcgccaccatgcccagctaattttgtatatttagtagagatggggtttcacatgttagccaggctgatctctaactgctgacctctggtgatctgcccgcctcagtctcccaaagtgctgggattaacaggcgtgagccaccactcctggcctaagatcattttaataagatttaagagacactaatttctgtctttcaagagaggtactaatttccatctaagcaggcccaccagaaagtagatatggaaaaacaggacaagcatataatatttgtaaagcaaagcattttatttctagaggaagatttgaaatccatggaagttaggagataacacagttgttttagttatttgtcacactttaaagtcattgtagcagttaggaaatagtgagatcttggcaaacaaaatgtggacatctaggagaagccaaagagttggcaacactttttaagcatctctggcagctcctgtctagttggactaaaggaataccatatcctattataaatcacatttccctggaactcagcttaaagggcaaactttagaaggaaaacctccatcatcctcattcaatacttcagctactgtttcttatccgcatctaaacaaaggccattaaatagagtttcagggaaaggcagagctgccaggaatgatgcagagatggcctttttctttagtaaaccagaagcttaaatgggcatgactccataagattttttgttttagtaattagcaaatagagtttcaaattcaaattgacttgaagcaagcagaagttttaaattaattaaattttccaggaaagggaagcctagccctaggaacagagattactcaacttgtaatgcattcctcaggcctaagtatccacacctataaagaatgacttggacttgcaaaggtaatagagctacttaagaagaatctctccaacatccctctgagaagcagcccagaaagatacaaggcaagggaaatctttccagggagaagaactcaaggtgctgaatggcttttaaaggacatttctgagccgggtgtgttggctcatgcctgtaatcctagcactttgagaggtcaaagcgggtggatagcttgagtccagtggtttgagaccagactggtgagcatggggaaatcccacctctacaaaaaatacaaaaattagctgggtgtagtggcacacacctgtagtcctagctacttgggggctgaggctggaggatcgcttgattctaggaggttgagggtgcagtgacctgaggttgtgccactgcacttcagccttggcagtagagtgagaccttgtctcaacaaaacaaaacaaaacaaaacaaacaaaacaaaacaaaacaaaacagcaaagacactttctctatttccaagggagcaagtcaagaacattttatactgcctgctcctaacaagtgattattctcaagcccctttctttcccctaaatgagataattttattaaggtaattctgtctgtggtgcacctttatttgcccctctgaatccttctccacgctccaccttcctctacctgcaatgctatcctgggaggctgacctgcatgaaaaaccttaaaggattcttacctcctctggcttccagttgggttcagccaatggcacagcagtagataagaaggaggtggggcgggcgcggtggctcaagcctgtaatcccagcactttgggaggccaaggcgggcggatcacgaggtcaggagatcgagaccatcctggctaacatggtgaaaccccgtctctactaaaaatacaaaaaaaaaattagccgggcgtggtggcgggcgcctgtagtcccagctactagggaggctgaggcactagaatggagtgaacccgggaggcagagcttgcagtgagccgagatcgcgccactgcactccagcctgggcgacagagcgagactctatctccaaaaaaaaaaaaaaaaaaaaaaaaagaaggaggtgggaggctaggagctaggataagggtacttatcttaagcctccgttcctgtgtccctcagctgaaggtcactgctcatttcaggccaaatggcttcatgggactctccctcctttagtaaccgctggccgaggggcaatagctcagctactacaaaaccccgagctcttgaattataaatcagaattaccctacgtccacacttaatttccttcttgaaatctactctctacatagacaagtgaattttcccctccctgaccaaatcaggcctccaaatataagcttttgtagcttgcttaaattcttgattaatttttactattaaatgattagtttgaattctcccttcctctcacagaatgtaagtttcacgagagcagaaagtgcattagtgttgttctcagctgtttgctcaaggtttaaataaaaacttaaacatagaaacaaaaatttttctttttagttgtgctttctattttttcttgggaccctgatagacagaacagtgaaattcatcatctaactgaagattgcagtattttggaacttggcattaaaagcctgactcaattacactgaaggagattgtacatctcacagaaagcttggacttgagcactgacctccagacactacctgagaaggtctagtagacatgattttccattggagaggtggtggtgtttttgatggcatgtagattgtgactggcaggggcatttttggaatgtaagcatgtctttgagtatgtgctaggtaaaattgaagagtagattgtagtgagcctccactgtggttctgctttatgccaataatttttcttttaattttctattcataaaataatctgcattaggacttttgccaattcagcagaattatgtcattaatacaaaggattataatagaacataaattggctggcccatgcatgaaatccaaaataatatgagtattcacaattttgacaaagcattcaccttaagaagaggcaaacaagcagggaactaatacagatacagttaggtttggtagaacactgatacttgtgatatttatgacataatcatggttctttttgtcataatatggtattttatatagctatttacttaagtgactatatgcatatgaactactaacatttttcacattttctctgcccatatttgggctgctcaataacagatagaaatgttatagttaaaaagaaaattattggccaggtgcggtggctcatgcctgtaatcccagcactttgggaggccgaggcgggcggatcacgaggtcaggagattgagaccatcctggctaacactgtgaagccccgtcttactaaaaatccaaaaaattagccaggcgtggaaggacatgcctgtaatcccagctacttgggaagctgaggcaggagaatcgcttgaacctgggaggcggaggttgcagtgagccaagatcgcaccactgcactccagcctggatgacagagtgagactccgtctcaaattaaaaaaaaaataaaaaagaaaattattatctggctgggtgtagtggctcaacctgtaatcccagaactttgggggctgaaggggtggatcacctgaggtcgggagtttgagacaagcctgaccaacatggtgaaaccccgtctctactaaaaatacaaaaaaattactgggcgtggtggcaggtgcctgtaatcccatctattcgggcagctgaggcaggagaatcacttgaacctgggaggcaggggttaccataagctgagattgcgccattgcactccagcctgggtgacaagagcgaaactccatctcaacaacaacaaaaaaaaaaaaaaaagaaagaagaaaaaaagaaaattgttacctattctccttagataaccctaatcttaatctagtaatactgtatcctttttgagaagatttcagctgtatcctttttgagaagattcagctaaaggttaattcagctaaaggttaacttcagctaaaggttaattggttaacgtgacatattacgcttaaaaatccctaaatgagtcgttttaaaaacctgtctttccctctaatagccagagtttctttgtgctattgtgttaccttctgattcatccgagtgatgcttgagaatgccaggaaaacaataaaaacatttcttgccactgagccctacctttgcctggaactcagtgaacatcctccatgaggtggcaaaattgttctggtattagtttgtagtaaaatttcctgaattaggagtggaaaggaagacaatattatgtaaaactttccgtgggttcacaaaaatgaagtgttatcttgtgttcagatcccagacttagagaaaatgattgtgttttctttttcttttctttttttttttttttgagacagagttttgttcttgttgcccaggctggagtgcaatggcgcaatctcggctcaccgcaacttccgcctcccaggtttaagcgattctcctgcctcagccccctgagtagctgggattacaggtgtgagccaccatgcccggttaattttgtatttttagtagagacggggtttctctacgttggtcaggctggtctcgaactcccaacctcgggtgatccgcccgcctcggcctcccaaagtgctgggattacaggcataagccaccatgccctgccaataaaatgattttgaacatatagttctatattatttatagtgaacatttaatggaggggaagttctgccttcaggaagactatgaatattgggactgtgtccttagtagacttggcactaaaaaaattcactcatttgacatcacaagattgcacaataaatattggagatgttggaaaggtacaggtacacaatggaatactacacattcgaaatgaagctgtagaattgaatttattgacaaagatgtttataatatatcatcattaagtgcacaaaaagggtaaactatatgctgaaggatagtttgggcagcaagcaaaagaacatctaattcaaaatgaattaaataaatatatttatttttataattatcataattacatttattaatctaattgttctagtgcagaggtaaaataggcttcagggtagactgattcagtgacccaacaatattattaaaaaacaatgttctttctgtctctctgctctgtaatccaaaatatctgctttatctcacagctagttcccccaaataattgtaagatagattccaggtgcaattggatattactacttgctttctcattcatatgctgaagaaagagagaatggcttgttattgctttctgcaaagaccaaagaggaaatttttgaagtctgtagccactatctcttcatttatcattggctagaactgctgatttctaaactgatagctggcggaaagaatgtgattatctttagaccagtcagactcacacattgagttaaaggcaatttctaaaatcagagtactgccatttcatggatagtagagtggaatgcatttggggatttggacacagttaaaaaaatctctatctaatctctctctatggatattctagaaaattaatattgtcatatgatagtatctggacaatgacttacatttctttttaattttcttcctttcactcacatgtatataatattcttctgtaaataagcatacattgttttttgtctctttaacattttagtatggaaaatttcaaataaatccaaaaataaagatagtaataaaatgaaacctcaagtatccatcacccagattcaacaattatcaacttctggaaaaccttgttttatgcactgtttgtaataagaaaaaaaaaagttgattttagttaaaaaagaagttaagatctgcttaacattttctcttgtccatagaatataccttaaagcaaatcagtaaagtttagctaaggatagcccaatatttttcctgtcaattgcccaagatctctcttaaattataccccaagtatttttttgaaaatttggtttttctcagtttcttatcctacatatgcatctcaaaaatttggaccgcagtaccccaacatcaggagaaaagcacaaaactctaggagcttgtgtatatgaaacaaagtggctcactaaaagcatagttattttgaaatctcatttttagttttaaagtctgtatttttttttttttactctatctaccaatgtttaatagaaataaaatatttcaaattactcaccattgaataaacttgacactgttggaagatggtccatgttggtcttttggcttcttgtcctctgaggcaccctgacaaatacccctgtgaacacaaggtccccaatttaagagtcatagattatagttttcttcccttttaagactccccttttgatctttgaccatatttccttgacttttaaacttcattctctttgaggactttgctttgaattcagtcctcttgttttttccattttagacctcctcagctcgtatgccctatcttaggattaatactcactttccagtcctggccaggcctggcccagtactctgcaagaggatcttggacctgtaagtcacaaatatcaaggtactcattcatttactaaatctttattgagtatcaaccatgtttctggcacttagctagtccctggggatactgtggttaaaaaggataaaatctcagtgtttaagaagactaaagacatcaggaacacaaaaaatatttaggcaattataaaatgggcaaataagtgctacattggatgaagtactgcatcctataaagcacaaagcagtatcctaagcagatgagggaagtcttccaggaatgagatgcagtataacaataggaaggaaaagtaagtggtggtaattttctatatttgaatgaaaacttactcttgctcaaccacgaaggatgttttcttagaaataaagggattgtcaaaagcagcattcagtatgggagcttacagtgatgtatctagaggggacaagcatgaagagtttgattactcgggagtgcagtttagaaaataactatgtttccttcacagaaaggaagtgttctgccaggcggagtcattgcttccttttctctcttcccttagtcctttgttttcttttttctcttgttttcttttctattttttctattttttttttttttttttgagatggagtctcactctgtaactcaggctggagtgcaatggtgcaatctctgctcactgcaacctctgcctcccaggctattctcctgcctcagcctcctaagtagctgagattacaggcacatgccaccacaccaagctaatttttgtattattaatagagacaggggttttaccatgttggccaggctggtctcgaactcctgacctcaggtgattcgcctgcctgggcctcccaaagtgctgagattacaggtgtgagccaccacgcctgggccagccctttgctgtcatatcacatgtggaacatccctacctgcctctcctatgccttcctacctgaagaaataaattaatcattttcccttctaatctacaaactgtgtattatactgaaacacaatgatactttaaaaaatttaagaattaaattgattcaaattttattttatttttagattcaactgattattttgattacttaatcattaaaaaatgatactgttcagtattcagaaagtttgggttcatttttttctttcttgtttctcaataaaagaaatgggtagtggtagtgatgttggcatttgttctgaaagataaatgtgacatgatactcatttcctgcctggcgcggtggctcacgcctataattgcagcactttgggaggctgaggcaggtggatcgcttgagcccaggaattcgagatcagcctgggcaacatagcaagaccgcatccctaaaaaaggagtacaaaaaaaaattagccagtctcataacttggcctgaaaataaataaataaataaataaataaatagactcatttcccattgagtaatccagaaagagacacaccctgaatggtattgcctaggttttcttctagggtttttatggttttaggtctaacatttaagtctttaatccatcttgaattaatttttgtataaagtataaggaagggatccagtttcagctttctacatttggctagccagttttcccagcaccatttattaaatagggaatcctttccccatttcttgtttttgtcaggtttgtcaaagatcagatggttgtagatgtgtggtattatttctgagggctctgctctgttccactggttataggaattggcaaggacttcatgactaaaacaccaaaagcaatggcaacaaaagccaaaattgacaaatgggatctaattaaactgaagggcttctgcacagcaaaagaaactaccatcagagtgaacaggcaacctacagaatgggaggaaatttttgcaatctacccatctgacaaagggctaatatccagaatctacaaagaacttaaacaaatttacaagaaaaaaatcaaacaactccatcaaaaaatgggcaaaggatatgaacagacaattctcaaaagaacacatttatgcagccaacagacacatgaaaaagtgctcatcatcactggccatcagagaaatgcaaatcaaaaccacaatgcgataccatctcacaccagttagaatggcaatcattaaaaagtcaggaaacaacaggtgctggagaggatgtggagaaataggaatgcttttacactattggtgggagtgtaaactagttcagtcattgtggaagacagtgtggtgattcctcagggatctagaactagaaataccatttgacccagccatcccattactgggcatatacgtaaaggagtataaatcatgctgctataaggacacatgcacatgtatgtttattgtggcactattcacaatagcaaagacttggaaccaacccaaatgtccatcagtgatagactggattaagaaaatgtggcacatatacagcatggaatactatgcagccataaaaaaggatgagtttatgtcctttgtagggacatggatgaagctggaaaccatcattctgagcaaactatcacaaggacagaaaaccaaacaccgcatgttctcactcataggtgggaattgagtaatgagaacacatggacccagggtggggaacatcacacaccagggcctgtcatggggtagagggagggaggagggatagcattaggagatctacctaatgtaaatgacgagttaatgggtgcagcacaccaacatggcacgtgtatacatatgtaacaaacctgcatgttgtgtgcatgtaccctagtacttaaagtataataaaaaaataaaaataaataaaaaaaagaaagagacacacccaaccattattgaagtcctctaaggtggggatagaggacacacagttcatcagggctgaggaatagagaatgggaaaacagatgaagaaaggcctgtgctgaccttttccatgccctcccatggatgtgtttttcctgcacgtcaagttatttaagcaaaggattgtttttgtctggatttttttcttttccaacttcagccatttcttttgttctttttaggcatgaaacattaaataaagttattcttaatatgggatattctcccctaagtctttttagatgataaggaaacagcatgtccattccaatagcctgttcaagagttctacttttaataatttgtgtctcatacttccagatagtccacacatagggcaggtcttattatttcttgtgtatttcattataaccttattaggcccaaacaaaataagagtcacgaataggcaggaaaacatatgactgtagtaagctaggtgttgaacaggaaactgtggcttccagagattaaaatagttttgtttttgatcttagaggaaacccaaaaggtgttcacttaggtctggttttaaacaggcagaacaacatattttaaagtaatatttctggtaattctgcagctactttgtagtgcctctgctgttctaggcattgtgctagatggtatgaggaattaaagatgaataagaacaaagtttccttcttaggagggaatacaatctaagttagcttttctctttatttatttatttatttttctgagatggagtctcactctttcgcccaggccggactgcagtggcactatctcagctcactgcaagctccgcctcctgggttcatgccattctcctgcctcagcctccccagtagctgggactacaggtgcccgccactgcacccggctaatttttttgtatttttagtagagacggggtttcaccgtgttagccaggatggtctcgatctgctgacgtcgtgatccacccacctcggcctcccaaagcgctgggattacaggtgtgagccaccgcgcccagcctgcttttctttattgtaaccaaaatcatttgatgacttccaaacagggcaacatatgtgtcaaatatggtcatatttaaataactatgccaaggttctgcagttcaattaacttcatttaatttggacacttctagtattagaaaaatatctttttttgctatcatccattaaatcatcaatatttttaaagattcacttccatctctctttttaagaatgaggtgttacataaaactataggtaaatgaatttgaaaaagaaagcaagtaaggctgagtgcagtggcttaatgctgtaatcttagctctttgggaggccgaggcaggtggatcacttgaggtcaggagttcgagaccagcctggccaacatggtgaaaatccaactctactaaaaatacaaaaaattgggtgtgttggcatgcaccagtaatcccaattacttgggaggctgaggcaggagaattgcttgaactcaggaggtggaggttacagtaagctgagattgtgccactgtactgcgccactgcactccagcctgggtgacagagcaagactctgcacccccaaccccccaaaaaaagcaaacaagcaagtgcaagtaagactttgtatctctgattagatgttgaacagtgaatgtctcttcccagacaatttagataatttacatacattctttctctggttagccttacagattaaaaaatggtggctttttaagttttaagttgagtgacttatcaaaaatactttaagacttgaagaccaccagtctagaagttagagatgaaatattagaatatggcagtaaacagtccagcctatgaactagaactagattgactgggttcaaatctcagcttagccacctactagtatgagacttgggttaagttaaaaaagcccttgtatctcagttctcttatttttaaaatgctgataacaataatgtttgtaagatgttgtgggcattaaatcaataaatatatgtgaagtgcttgaaaaaaggtatggcataggcaaacactccatagagtgtcacctattatcatttttatgtgagtgtgggacctgctatccaatgacatcagtagtctcccactgtgacataaaaggattgcatacaaagaaatgcttaataaataattcattcgttcaaacaagtatttttgagagcctaaattctagattctggggatagagccaaggaggacaagctgaagttctcagttttaagtgactttcatctgaatgaagtaaactgacaataaacaagaggaacaaatatacataaacatattaagcattactacctactttgaagaaaaagaaagcaggctaaagggatagagactaataaggaataataatgggcaagctgttatagatggggagatttacactcttttgaggagatgatatttgagcagagatatgaatgaaatgagagtgaatgctgggaaaatcaacaggaaatgaattctagaaagtgggaacagcagaataaaggccaggaggcagaactgaattcaggggttcaagagtaaacagaaggcccatcgtggcgtgaagtaagatctagtattcgaagatgaggtagaagtagtcaaataattttggatgaataatagatacatttaatgactcaatcaaaatgatgagacatcatgctgaaaggaagcttaagatacatttgtaaataagattataagatgttgagtgggactttttttgttgcccataattgaaaataagaagagctaagtaaccccctttctatgagaagctcctaatagatgccaaatattgaggccagacactgtccccacctactaaagggtatgttacgaggcgaaaaaaattctctcctaccagcaactagcacctagctctggatacgcataaagagaaaactggagagagaacagtgcaagtcagcagacagtgctcacagggaaaggttactcctcttctcaaggggaacagaaggattattatttttttcttgctgaagccaattaatgggagtccatcagagaatgtttagagattgtgtgcgagtttgtgggaaggaagactggcaattcatttctcagctggctggatggtaatttactaaacacaccagtccctctggagctactatggcggagcgggggcgaatgtctccgcggagttgtgtatttgctacctgaagtttaggactcacccctgaatccaaaacagctgctagtcttaacatttctgaaggagaggaaattgctggagtagcttatggtaacagagttagaaggaactgtggttcagagtttgttcttgagaggggttaaattccctcctttatccccatcctggtcttttgtggcccttggagcatttagaagatggtctcagaggttactatggctcaatgcaaaacagcatggtggtaaggaagggagcagaatagctggtagtgaggagacactccagctggggaagcagttaggggcatggtctgctgtcagggtccaggcttttctctgagggattcctcagtgagtgagggggcaaagcaaagacgaagagtgtctatagaaaaccaagcacaccaccagcacagatttctcaacaccaccatctgttagcaatagacaaaactggattgaaccagagaaaaacctaggacgctttctcacgcagacatgtaactgattatgtaagatctctaccacctttgtcttctctctctgaccccaaaactagaggagttcagcagcggggagtgaggatggttgtctcagagtcagatctccttccaacttctctactccaagcagtcagcctcacagtttgtgttgaggggaaagaaaggtaatcatatttatgttagtttcacaatccaagttttaaattggacaaaaataaacttcaaataactgaaactggtagaaagttagaagatttgcactttgggaggccgaggagggctgatcacgaggtcaggagatcaagaccatactggctaacacggtgaaaccccgtctctactaaaaatacaaaaaattagccgggcgtggtggcgggcgcctgtagttccagctactcgggaggctgaggcaggagaatggcgtgaacccaggaggcggagcttgcagtgagcagagatcaagccattgcactccagcctgggcgacagagcgagactccatctcaaaaaaaaaaaaaaggacagttagaagatttgctaggatattcattaaaggacacgagaataagacttgacaatcatgattggaagccttgattagaataaaaaatataactcttttgtatctatgctcttgttgagacacattacatgagtaaccaaacaatgaaacataacactataaaccacagcacatctatggagaaatcaaaatgcactaatcgaaaattataatttcgtgggacattttatttaaatgtaaaatttcatctggcttctcagttttgataaagtagagagtctgtcaattgcttctttcttataataaagtgagtcaatcttccttccatcagcaacatataatacaaattcttcaggcccttgtcaggaatataaactcatactttctcctattccgtttctaaaaaggtcttctaaggaagtaatatttaagaaagttcatctaagaaacattgtaccctttgtctaagtactttgaattctgcctttgaatcaagctagaccactggaagtatatgcacctgaccacaaaaatatatctcctttaaaaatctgtcaccaactttaacttcaaaattttattctcaggcttctttgaattatcataagaaagtttataaaattctcttctatttgttggtaaaaatattgctgatattattcaacgcgttgctcagtgtcatctccatatgagaaatttctccatcaacttagtggcaggaaaaattctctcttgatttgtttctttcttttaaataatgagaattgtgaaactccctaagtttcccttgttattcttgctatcggcaagttcaaagccaaatttgcagctctgtcagagcaagtctcttatacaatatgtacaatgtattccacttcggttttttcttgaatttgaaccttattttatcagtatattttatattttaggggcgttgtctatttgtaaagaaatggagtataggtaaataaatttggttcatgtgctaggaaaagttggttcagatgactgaaagttgatctcctaacatgaaattgattaatctttgaggtgtttttcaaagactacttgcaaaaaaaaagaaaaaaaaaaaagagacttaaaatggcccccaaaatgttatcttcattcattagtttaatatcattaaccaggctaaactgtatattccaataaattgaacaataataggattattttaacattattactgtcagttaattctaaaaaccttatctttggtttttattatatgtaccattatatattgaaaagcttagcagatcctcacatcaatgtccagaaaaattatctccagcattatgaagacacttatatcagttgtagaacatcttatagaagaatagggaagagaggtaatattttgggtaagaatgtagcacaagcaaaaggagagtcagtgacagagtagtgacagcttgtctctaaatgctaattaattatattgatcctctttgttttctcagcttaaacaaaataaagtgcatgggtaccttcaaaacaacacatgatagaagggaatggattcacaaatgacaatagctgtgtttacctggacacctagttaattcactagtttaacaatattggccagtctgtaatgtacatcccaataaactgaccaataaaaggattgccttagcattatggaaatatagctaaagtataagtttaagggcttccataaattaatcagattattattatacataggcatttatgtattatcaggtataaaagacatttgttcaaactaggagatattcaaataatgataaaaatcatctatgactagccacctgggaactatacttttctagtttaaagccataagatgcctcattgctttgacattgctaagtataaaaaggactgtagaataatttgttggtgataaaaatgtctgtggtcacattgctattttacttattatgcaatgtaagatatctactgtggatttctaacagactcaagtccacaaatatatttctcctgactgttcctgacattgcacagaatggcacagggaacacagaccaacacacaaaaagaagagtaactctttgaaaacattttcttcacactgtagtttaggacaaaagtattgcagaataaaatttatggttttagaaaaaacagcaacaaaaatttgaatgaaagacaaacttttgctttttcgaacttttggaagacaaaattatgactctaatgtttcattccttcttctttccttgccattcaaatttctactaaagtgtaagatatatcataaaatttgataatatacactgcaatgcccattgagcagactgaacaaaggccattaatatagcaaggaagacatatttttaatatctttagtctgacattcacttgtcctttatttacatatgcgtaatctcttaattttctacaaattgtagcttatactcacagagttttaaaaaaattcatgatagccctctcattttctgtatctacaattctaggttatatattaccctaagtatacaggtccataggcctatataaagaatttatttgaatttgaaatcttgattttgtgaaagaaacaaatgtcttgagattttgttaaaataagtctggcaagtcttggcccaaagttacactgagagggaatctgttttcctttgaaaacaaaagtattatcaatattttcataaaatgtgagtataaaatagaacatagtattattaaaccatattaacatttcattggcagagatttcactttgttaaaggctgtataagaacagcttaatctcataacccagaagtttttactgttattattgcctctttatttttggctaaagtgtaatttttaaatgagtatacagaaacctaatactatatattgaatgactttaagtaaataaatatccatgctattcatcaggataagtgacctagtgaccagaataaaaaggatatatgttggtagcccctagcacagtatgcctcagcacagaggtttcttgggttactgctagtgaatgattccaattcttggccgtctgatcccacacattacataaattccaactcctgcatctgtttaggtgagctgttggctaaatggatatgtaatgaaattaaacaatatttttaaggtgctttttaggatgggttataccccctctttttctcctcctttccttgcaacctgccctctactcattctttttatgcatatttttgagagcctgaatatgctaggaagagggtttcagtctgttaagaattcacaaccttgtggagttgagatacaattaataaaatttctagtataatgaggtaagtattatgataccatgaaagcacagaggagaaacacctactctgttttgtaaggattagggaaagcaatttagagattatacctaacacaaacacacagatatttgcatagtatgtgagcacacgtttaaaaaaatgtaattttcaccctagaaataagacagtagtgattcagcgtgagttgatatgcctgtctccactataatgaaagaaatataacgtcttaagtatgggttgacatttgcaaactaactgatttttctagaagaatgatgccacataatttaaaaatattaatgcttttctaatctctagtgtattttcaatggctaacatagttaaaaccaaagtgaaatttttattatgtacataatcgaatgcaaattgtgtcaggctagtttaaaaaatatgaatgtcagtcctggcttggcaatttaataactatttggtttttgaccaagtcatttaacttaattaaacctcagtttcttctctgtaaacaagagaaggtcaagcaagatagttttaaaatttctttccaaatttatacgtctgacttttctaaaaaatctggtttacactaatacttaaaagaaattatcttaaaacaataaattataaatttattttttgctcttgctccctgtaaaatttgtccttgtcctgctagtcacatatagtccccactacaccagccaagacttgtcagactggttctgttgagatcatcagtgacttatttcctcacttcaattcagcccacaaagtcattgatagagctggattcacacacttggatgtagacctcgaccttcacaggactcttcattgctggttggcaatgatgtatcggtgagttagttccctttttctttctagaagtcttaaggtaacttttagtttaaaacagtatgagccacaccaaggaatgtgtagatctacagtttattatttttttaaatatagaaacatatttttgagattttacataaaattatgtcaagaaaaagatttctattctttctgtattagtgtttcctgtcctcttttgttgtatcccatgtgtttttctgtttacttttagaaggtttctacacaatgtaaaggtacatggtgtttgacagctgtcttttagttagtttggccatatgtttcaagaaagatataacatatttttagcttgggctttgtttgtcttattgagaaacacttttattttagaaggtgtacatgaaaaaaagtctgaaataatgcagaaaaaaatgtttatttctgtaagtagttaaaaatttaaaaactctagatgttttgaaagaatcagaaacaactgaagaaaataatatgactaaattattatagcctgatttaaaaaataaatccactgatatgcctggccatagtcaacttctccaaagataagtcatgatcattttgaggttttctttcaaagttagaaactaatcagtaacaaggttttggggtactagttttgtctttgaaaataattttatctcctgattaaaatttattttctctgattctcatattggcatatcattttttattagtttttactttgagaacagtttgaaaatgttaaactttgaatgaaatctgtggtcttcatttaacatggaaaaacaggttctgtcatcagttgaaagttctacatacttgttattagaagtttaatactcttctgtacatatccatgaagcaactaaaagctacggatactaaacattttgttgggcttatcaaggctccctgccttttgcaagtatttctttacaaccaatgatggttttgtatcctattctctttttctcattgactttactatagaaaacagtgcttcaagaaagcttccaataaacttaacatactaaatagattacaagccttatctatggtatatgtcagagatttggaatttggttataaatgtgtagaggcggtataatgtgggaatactggagtgaatttttctgagtgtagtctctaatttgaagcaaaagatgtgactatttttaaaaatcctgctgcagaatagatgcaaataatctctcatggaaaaaaccaaaaaccaaaaccaaccatctaacaaacaaaaacgtcttcctgatctgaagattgtatgaaagatgaagcacatctatgtttgagtgggtctagatgagataaaatgttaagagcatgtactagagcaaaaaaggattaagtttattattcacatttgctgtcgtaaatgtgccaacaggagtgttatcgaggaagagggataattgaaatcctaggatataagtagacaatttcttcttaaggtcattggttttaactcagaaagaatacaagaaacaggtggggaattttattaaatagcatgctccttccttttcagtcagatttcggatagccttctccctgactctacctgaataagaatcagttttttttttttttttttagaatttaagggtaggaaaaaatttaaactgggtaagcattattcttcttgtactgccattttctccaaactcttattttggactattctttgagcatgaagagatcaacacatgaattttataaacacacaacagaaagttaaagaaaactctatcaggcataagtttatagagaacagatttgggaagagaagaatgtgtccattaaatatatttattggtcataggggtgtatactaactgtatttatcagcaaccactgagaagaagtgaaaataagcagactgaatttataggcatcgacatccacacatattgagatggctgaaggtgaaatgagtaatattcaaatgacacaaaatggacaactttaatttttacctaatagggtaagcactgtctctaaaagtgtggtccgtagacccctgcattacagtgcttattaaaaataggaatctccagctctcatcccagaaattctaatgaatctctggttgagacatggaaatcatatttaaaacatttacacaatgtaattcttatttaccctaaagtttgacaagcactaatggtgtaaagacatagaaaaagaaaaagaaatgtgtaagcctgaaagaaattaaaccataaatgaaataggccagttgttaaaagtagttctgttttatttaaattggtgtaattacatctgaatgggaggtgctctttcccagtcacctttcccttcaagggagaagagtactcatttatgcaacatggtgatgattaagaaagagaggataatttcagaaaggaggggaaactgaggggggagaacatagacattttttgcttagtttgtgtctgataaggaggatgactttatatggatcataaaaatctatttgtttacaggaaaaaccttggtataaaattaatgtagcagtgttaccctgtgacattagtcagtatggatactgaagagacactccttttaggcttaggcccagagttgctatatggttgtgttataagtatttagcatgtgctcacacttctccttcaactagaatcagccctgatccatataacaacttttagtgagttctcattgcatactaagtcctgtgtggaagaaaactctctgttgagcacctactatatattgtgtattttataaaatgcaatttcattaaattttggtaatgttttgataagtggttattgctttcattccttttaaaagatgaagcacctgtggctcagattgtctaggcggttagtaagtgtcgaatctagaatctaattctgatctttctgattttaaaatatacttttttccctgtaacatattgtctaccatgtgtaggaagctataagtagaatctttgagaagtttacagagaaaatagatggcaacagagaaatagaaaataaacgcacacatatccacacatggagaaaatgttggtgcatagatttaaaaaaccagaagatgtaaagactaatatgaaatcatgcacatttatgctgaggaaagaagtgtggaggtgtaattttactttcatttataagttttaaaaacattttaaaaaatgcattgcctgcccttatacaaccgactttgtatttaaactaaataaacagtgatctatcttttctgcactgtttcaaaggtgatcagagtatagcactttaactacatcatctctgttttctaaaaaggattacatttgctatattgtgaaaatcatgtttatcttagagcaatatttcatggaactaattcactggtctgcagtagctgtctgctaaatgaatctttgttgttctgtcattgttgtctgctttcctccaaaaatatgtcattgcttcaacttaaagagaaaataaatagaaacaatccagagaaacatgaaaaatagcagtgtcgtgtgtttccgtattagcactgagatttataagcatgcctgatggttttagtgcttgtgaaagaggtagattgaacagtcgtgaagcaggtcttctggaagggtaggaggtaaaatgggttctctggcttgttttatggctctatcagggttagagtttagagaaactgcacagagaagttcttcaagtgcgctcctttggatctgctctcattgaagataatagctaagaactgtgaagaatactttcacattttcaggttttaataggtttaaaatgactggactagagagaaggaaggttttaagaggctgagaaagaaaaatgggctgcagaaacactgagtcatgccagaacctgtaagcccaaccttcttctcccatgtacacacatggcctgtgtggtagggcaatttttagaattgcaattctaagatgatagaactaatcttagggggatccaaagtactatacaggcatatttaaattctattttgcaaccttttatctgaaaatgtcagatgatatctctgttttgaaactgcaaaagcagacacagagggatttagcactttgtttaaagttgaactgtgagtcagtgcaggacaaaataataattgctatctttagtttcacatgtactatctgccaactactgtcttaaaacatcatatgcatttaaactttatatcaacctatggttatattatcatactcattttacagatgagaaaaatgaggctcagacaggtaatttttttttgcccaggggtaataataaaaggcagaactgatggttaaccagggtctatctgacttcaaagcctatgctcttaatcacagtgctataccaccctcacaatgtctcctttgtctgcctaagtggttcttttactactttgatttaactgacttactgtcttaaaaggtgaaaaatttacattttcaagaaacattgttatggatgatctttaaagtagacctctaaggccagtggataggaagcattgctgtatgcattctctaaaggaagggaacaaaatgctcaaagatgagataatttgcatgtggccacaggaatgggtgagtcagtcaagacagagatgtagtctgtcctcccacttcacctgtatactgatgtcaatacagtcaaacagaagagttaaattaacaccggtggctacatgacccaagacatattattgttatttttattactattaccatttaagcttgtatgaaaatatgtggcccatttaaaattagttactttacattaaattttgtcaggtcacagttagtaaaatttagagagggtacatatcgtaacaataaaaatattatttgacgtaaatatgctacatatgtaatttcaacatatgttttctcatttggtactttacaacactgagaatcagataattttaatattaccatgactttacagctagggaaaccaaaaattaggaagactgagacttccaaatctctgctaagtgactggtagagctggaatctgagcacacctgttctcacatcagccctgtgctttctagtcctggcttctgccaggtcatgattctgggatcagaagtgcttctttggtgaagcacagataacttaccttggctttcaaaaaattactttatcttagtgtttcaactttcctaattcagaaaataccaaagataataaatgaacactttaaaaatatttcaaaccaatcttttaattatatagtacattcaagtcattattaggcatttggggatacattatttgattcaacaataaagctatatttggccttttaaaaacagggtaatgaattcttgtactaaactgtaggacaactggcagctgcctgactcaaatctctgaattggatgggtccgaagatgaacgctttttaaagttttctttactagttgaatccctttttgcactggaagcttaatgcagacccttgatgtttggagcagaattgctgtgggtggagtgggatagaggctagaagcttcctctaccttcctgtcttttattcccttaggcatacgtgaggcatctgagtggatttttcaacccaccttaaagctaatttttcattatgaaagaggaaataatgacaatggccaacttttgtggtgtatttactgtgtgcctggcatggtgccatctcccttgtgttactttatttaatcttcagaagaatcttctgagttaggtcttatcattatctccatttgtgggtggggaaatgtagatttagagaaggtgagtaactttcctagagccacctaactagtaacaggcagttaggactaatcccaagctgtttgatgcctaagcccaagtctttatccactaaacaagaaaatggaagtcatttgcttaaagtcatagagcttgttacaaagaggctcttgactagaaccttggtcttctgatatattaatattataattattaattgtatctcaaaattatgctgctagagaaaattaagttaaaatagtttaccatctttcacatatacagaatttgcaagagaattagtaaatacacgtcttcatgtcctcttttcccaaagatcattatgtgaaagtggcaatttcccttgattgcaacaatctgttttgcatattataatagtatcggatttagctacgagtgacaggaaacccagagtaacaggggattacataaaatggaattttattccgtttaatgtgaaacaattctggagataggcaggtaagagctaatagggaggttcacaaaataattaggaatctagtctcctactattgtgctgtcctaccagcttgattacgtgtcttccaaatcctggtctactgtggcaatccatgcttcaactagcacatatgtattctaactatgaaatgcacattaggattccagccaacaaaatagagactccattggaaagaaagtattcatatgctgactcttatggacaaggggcactatttgatttttctggtggctgtgtgcctaaccaaagatcaaggtttctgttattagaaaaaaaagaataaatatttgggataggcgtctaggagtttctagtatagctgtattaagtttgaatggtaagaggtatagcccattgtgatgaacataggctggtggatatatagttttgaagtgtaggcaagtgagctgagctgcagttatagatttggtagtcatcagtatatagatatgaattaaacgcatggacattggtaactaaaagtatttgttcttttgggtaaaataatgcatttcttataatttttatggtattaatttgcacagaaatcctactttattctaatatgaacctgagcttatttcactatgttattattaaatgccaatatattagaacgtaattgtcaaggtgagtatataataaaaaatttcataaattttatgtaccatccaaaaattaaaactgaattcttacatatatttcaggtcgataactggggcagaaaattctttaatcaggaaaactcacttttcattttggaagaattatttaaacatcgagagggtctatacatttttcaatttctcctcattgctgaattaattcagatagaattttgttacatgtagaaatttctagactgtctaaagaattcttggtgtatggtttagagtgctttctaaggaaacagcaagccagaggacacaacaaggtgtcagcatgtggcccaactgtcacattcaggcacattttaatcagggtctagagattttaaaaagttggtgtatagtagttatacatattttgggggtatctgtgatattttgatgcttgtatgcaatgtgtaatgatcaaatcaaggtaactgggatgtctatgaccatcttgtgttggaaatattacagttctcttctagctattttgaaatgcaaaacaagatattgttaactaaaatttccctactgtactgaatggtagaacttattccttctatctatacatttgtaccccttaaccaacttctcaatacaagtagtaaagtatgattttcaaagtctggctttctcaggtatggtatttagattgtttcaaataacttgtagtctcttagtttgactgcaaattatttcaaattatctgacattgtagtcaacagaaaaatgaggcatttgaaaaattgcctgaagtctgattgtttaacaaatgctgaattttaattaggatatgtaactttttgtgttatgtgaggcatggaacattagcttggatgaaaattgaagaccatttagatcaatttaaatttccgctgattttttaacatgtgaagaaaaggagagctctcaatatcatacaagttggggctcaggggatgctggaactcgtttgatgtggagtatgctctcagatttctcatctgtttgaactaacactaagacataggttactggttttacagtttagatctacttccattctatcatgcaaactttcttggagtcatctagacaatgtcaagaagaagatttggtaggaagacagctaaaattttaaaaagtttctgaaagtctcaagctatatattagcagccacaagagtgtctctagctcaggtttctcaatcatttttcttctgatacacttgcagtgatatcagcacactgcttgttaattcttatttttcttccacattttgaagtgtgtaaaattccctatgattggctgcaatggcatcgctcgttaactttgctgtgggatattgttgtgtataaagttgctcaggtaatgccagtttattatcttgaactaaaaagagtttgaggaaaagaaagcaaatatattagtagaattcaaacttcagtagcttagtttaagtctataaacccataactaattacttaataatatctttaatttttttgcaacccacctatctgtatgtagttgcaaatttctagagatcaggccaagtgtcaacttaaatatcagtttgtagtcacctgtgctgtaccatatttagttgggaacttaataaaaccttgatgataatcacagtggaggtcagagacattccttactgttgagttgccactaatatttatgtagtacacctatctaacaaagtctattgatatcatatgcaatcttcacaacctccttttaaaggtaagggaaagatactgtcacgtaagttttatggttggctaaacagaaatagttaaactctgggttttgtaacttctctatgagaactagccgtaattattatggtagggaatgcaaacattgtgattcagcccaagcgcctggctgatgctatcagatacttatagatgtgttttatcttccagtggataggacagaaatatgttatttgtaattttatgtggagtaatttgcttgtatttcttctttttttaaaaaaacagcaatgaaaatatataatccatgcacgtatatatgatattctgttttatttctactgtggatatttttatagtcctgttctagaaagtgtgagaaggattaattatgtcaccaatgcttgctggtttgggcttttcacaaagtaaaacacatctcaaatacttttgttgataggataagcaggcacaatcctatgagctaagctacggtcaaatacatatcatatgccaaaacaaatatatagaccaatggaacagaacagaggcctcagaaataatgccacacatctgcaaccatctgatctttgacaaacctgacaaaaacaagcaatgaggaaaggattccctatttaatcaatggtgttgagaaaattggctagtcatatgcagaaaactgaaagtggacctcttccttacaccttaaacaaaaattaactcaagatggattaaacttaaatgtaagacctaaaaccataaaaactctagaagaaaacctaggcaataccattcaggacataggcatgggcaaagacttcatgactaaaacaccaaaagcaatggcaacagaagccaaaattgacaaatgggatctaattaaactaaagagcctctgcacaacaaaagaaactatcatcagagtgaacaggcaacctagagaatgggagaaaatttttgcaatctatttatctgacaaagggctaatatgcagaatctacaaagaacttaaatttacaagaagaaaacaaccccataaaaaagtaggcaaaggatatgaacagacacttctcaaaagaagacatttatgcagccaacaaacatatgaaaaaaagctcatcatcactgttcatcagagaaatgcaaatcaaaaccacaatgagtaccatctcatgccagttagaatggcgatcattaaaaagtcaggaaacaacagatgttggagaggatgtggagaaatagggacatttttacactgttggtgggagtgtaaattagttcaaccattgtggaagacagtgtggtgattcctcaaggatctagaaccagaaatactatttgacccagacatcccattactgggtatataccaaaaggattataaatcatgctactataaagacacatgcacacgtatgtttattgcggcactgttcacaatagcaaagacttggaaccaacccaaatgcccatcaatgatgtctgttatacgtatctcatttcttcttcaatgatagactggataaagaaaacatggcacatatacaccatggaatactatgcagccataaaagaggatgagttcatgttctttgcagggacacggatgaagccggaaaccatcattctcagcaaactaacacaggaacagaaaaccaaatactgcatgttttcactcataagtgggagttaaacaatgagaatacatggacacagggagcagaacatcatacactggggcctatcagtgggtggggggctaggggagggatagtattaggagaaatacctaatgtagatgatgggttgatgggtgcagcaaaccaccatggcacgtgtatacctatgtaacacacctgcacattctgcccatgtaccccaaaacttaaagtataatttttctttttttaaaagaccaactattgattggtggtattgctgtgaagaggcttcttctggtaaatttttctttgaaacactgagccttgacttgtcattttccagtgcttgccattagctttatttgcactagtacattttccccttgtctttttgctgttgctgctgcttttcttttttagcactattctaaaaattacacattaataagcaataataataatgcagcctaagcatattgcttgttttctggcaatttggggctaaaaaaacaaagcatactttaactgttatattcacttgacttgtcactaattatacatgtctccagattgaaaagaaaatcatataaagaaagaaatttgatattactaaagctgttagaattcaatcagtctatctgaaggtgattttacacgaataggtgcacataagttttgatagatgaaaatattgactggacaagtgtttatgtatgttcaggaggaggttaattatacaaacgtctgttgatatgtaaaataaatttattccttcactttactactttctttgagcatacttttttcacatctaatttggaggaattcagtattgaatcacttactgagaaaataaaaaagtaactaagaaataggatcaattatatctcaaaaaagctaaaaaatagggtgaatcagtttgaaaaacaatgctatacagactgggaaaagaacaaataatgtttcaagtgacaaacatcttagtaatgtggtcattaccactattactaataattaaaataatgatgatgataattatcatcctcgttatttgtacaatgatttttccacttgggagctcaaagtaccaaaccgccttctcatttttatctctacctagctcattaggttaggaggggtctggacttattatccttgtttttcatatggagaaattaagacagataattgaatctctgcgtacaagactatataataaatgagttggtggcagggctcagaaatataatctcttaattgtttattcaaagtatttttgactggattctctttttcctttgtcccatattatcccttttgtctacttctagccactcaggagagcatgtcactaaaatagttgtgagtaatgtggaaaggtgggggtcagaagaagaatcacagtggtaccttggacactgcagtgatgtaaattccatgaaaatacatatataatcttccttagtttttttttcatattttaagaatgtcctatgtctctcgctctcttttttttaattcaaacgccataatgttgttcttaaaaaatccaccataaaacaaacaaatccataaattaaaattaaaatttctcacttatttgttattcggcttcttactaataaatattggttgtgtcttctatatattttgttatgcacacacatatatagtttcattatttatgaaaaccgaaacatgaaatgcatattattctataactttttaaaattgaaacttatcattaacctttttaatgttaatacatgaaacctacttcatcaatagaatggctgcattgcttacatttttgtcttgattaaaacttactgtagaacaaatagaacgtgtctaatatttcacaattctatataacaatcatatacttttgataatttcatgttttctacaagcacacattcattttcttcatctgacatgttttgatattagttgagaaacccttctctccctgtattccccccaaagttttgcttacgtgtgttatacccatctcctttcttctgtaacagattaatagcaagcattcagggatgaaggaagaagagtcagttttgggggtttcttaggctcagttgcacataaaacataatctcattgtggagaagactttttatattgcagtaattgacattctaggaacaggtgtttggaattctactcaagggaaaactggagatgggaaaggttgaggagagtaagataaaagcttccctggttacggccccgtggaaaaatcacaggaacaaggcaggagaacaagcagagcccctggagccttccactacatctcagtccctttcccagggacaggattatacagcgatgataacaccattgacttctatgccaatgctctttattttgtgtccagccagagccaggatctaatgatggtgtgacaggggccaacatgataatattatcacttcctgatcctatatcatcaggaaacagagcgttcttgttttctgtaaacaaaaggcatttattgtgaaatgctttgctgtttacacgttcatgatctaattttaggtcccaaagtgctttagacggaatggttatcccgccccttactgatatatggggaaattgagctcagagtttaaatgatttttccgtcgctgatctgttaatgaaagggctgcacttagaattctccttattctgattcaacacccagtactcctccaggagaataccatgttttcctcaagtcctcatgtagcagacagttagcactctagaaaaaagaaaaaagcatagcacacactggcgtaaatacctcaagaaatctaaaataagagtatcatattcaaactccttagtcatctctgacttattatttcacatttctggctttagagtttgcttaccaaatattataacccaatgggacagcaactttaccaatcaaacaaaaatcatgtggatcaatgtttttcagtaacatgtatttttgaaggcagaacaaatagaagttgagggaatctcatgcaaaaagaatttcctgtagctttttttttttttttaagacggagtctcgctctaccgcccaggctggagtgcagtggcccgatcttagctcactccaagctccgcctcccaggttcacgccattctcctgcctcagcctccagagtagctgggactacaggcgcctgccaccatgcccggctaatttttttgtatttttagtagagacggggtttcaccatgttagccaggatggtcttgatctcccgacctcatgatccgcccgcctcggcctcccaaagtgctgggattataggcgtgagccaccgtgcccggccttctgtagcatcattaaagcttaaaggtaaatattagctcaaaacctcaggttctttaggaaggggcctctggttgtttcttctatgtatcctcaaagtttggtttggaaatagatcagaaaattagaagaatagaattagcaactccatgtgaaacctggtatgcttcaagctgtaacacacttcaaaggctatttaagattctagagtgctagagaaaaggcttaaaatatttttgtagcccctgcagtgtctaactctatatcaagtacatggctggctcaacaagtgatagctaacatttaatattgcacttttctacatgtcaggcattgttacaggcactttatatgtagtacttcatttaatcctcacaataatcatatgaaataggtactatcattatcatcttccttttatggatgaggaaacccaagcacaaaagtcaaactacttgcctagcaacaggagtcagagtcaggactggcctcagcagcctggaaccagggtgtgctctaaacccagacagtacacgaccctccaactgaatgtcctttattcccccaaaatatctgttttgtctaatgagtggatgtgttgcatgctctgaaataatctatctatttattttcttccttaggccagatgtggtgagggctaggaaaagagtttgttgggaaccctgggttatcggcctcgtcatcttcatatccctgattgtcctggcagtgtgcattggactcactgttcattatgtgagatatagtaagtataagctgccttggcatcatgtgatttaccccaaatatttcctcataccttgctgttttgatttgcctcaggcttattcatttatcactacgattcatttgcatagcctgtacaaagggatctttacctgctttctctcttatttagtcctcataagtcaaggaggattcttttttctatctttgatgtagtgatgctttctgctgggaacagcatgcttatttgcatcttccttaataagcaataagtgagtattaatcaaaggaaaactacaggatagctagaaccaatgtcttgagttgtttgaggtcacagggcaagcatcttgatttaaaataattctgaccgggtgcagtggctcacgcctgtaatctcagcactttgggaggctgaggcgggtggatcacttgaggtcaggagtttgagaccaggctggccaacatggtgaaaccccgtgtctactaaaaaaaaaaaaaaaaaaaatagccaggtgtgatggtgtacacctgtagtcccagttcctggggaggctgaggcaggagaatcacttgaacccaggaggcggaggtttcagtgagccgagatcacaccgctgcactccagtctgggcaagagagagagactcggtctcaaaaagaaaaaaaaaaatccaactcgttgaagtcctgacatcccaataaatcaatgacacaatctggagtcataaagaagtaggctctattctgtaccagtaagttacaaaaatagtcatagtgatgtattgttgagtaagtgcctatttctgttattaaaatctcatcttaggatatattgtaggtgattaaagaggatagggtatgccaagaaagctaattataaagatgttcaccctgcggttatcaggtacctcattgctagatgaactgttagttgctatgttattagaaaggtctccagggtacttcagaactgttattctgggatgtaacagcccttctgaagtttcctcctactctgcctagggttttaattacttgactcaaccatgacctgttagtttaatatcttcctctgttactagattatacttggatgttcaaggcaccgtaaccatagaagctaataacttgattctaatttaattgggaccttgttgaagtttctttccagtaacgagaaagagtactctgtaacctggttatcttcctctactatccacgcaagtataatctcaatttacaaagcaaggtggatcatttctggatagtttaaaaaaatatttaaaacaaagatttttttggtagaatttgcatacaggcaagtctttaaatttggagtatctgcatattaataacagatttttctgtagcacactttttttttgctttttgagacggagtcttggtctgttcccaggctggagtgcagtggctcgatctcggctcactgcaacccctgcctcctgggttcaagtgatttttgtgcctcagcctcctgagtagctgagattacaggcatgcgccaccacacccggctaattttttctatttttagcagagacagggtttcaccatgttcgtcaggctggtctcgaacttctgacctcaaaagatctgccttccttggcctcccaaagtgttgggattacaggcataagccactgtgctgggactgaagcatactttaaataaaaatgaattgctggaataactttatagttctacagttctgctgagaatattgagtcctactttgttgtaagcatcattatttgtccccatggatgtctaggactgttttacacacttttgtgtgtctagaatttatcagaatcttggcacatgttatgtgctttataaatatttattaaatactgaatgataatatcaaatgaatcatgcctacaatattttcttgggccatacttcggcttgtctgacttcacaaggaattcctagtaacactaggggctaatcacctcagtgagagaaaatgtccctttctacttctcatttgcctcttcccaagccaagttttataagattcataaatcttactcatatgtatacagtgaaaacttggcaagaattttttcagtaacctgttcctgaatcctgttgtttggatgatcaactgagtaatactgaacacacagcttctactgcccacacagtacacctgaataaacagtgattgttgtgatgtgtgttactgccttctatttgtgacctgctttctgttttgggatgtaaactaaccgagtggctttggcagacaaatatttagaagctgacatgccaaaataaccaaatcaaaccaaaccaaaaaaatctgtcacagaaatagacagatacagacaaaggtaatcagatttggaaaaatatcattttggttctcatttcataaagcccaggacaatgtagaattctgtgtatggttcgtgtctggggcctttgggggtgcatttctgcccctgtgtaatttggatgtcagaagatgaatctgttataagcaacatcactgcagattatagaatcacaaaactgctagaaatttaccaacaaactcatgtttatccttatttttaacttttctgttaatattcccaacatattttagtaactactcataccatatatttatggcagctggtaatatgttttaacagtggcatgcttaagtctacagggtaaagtaaaatactgagcacagataataaattgttaacttggttaaaccatatgaaattgccaatatttgactatttttgacctgtactaatggtgattttaaatcattcaatctaataagccaaaaaactacatttaagggtgtagaagggtctgttagcattctgtctagaatcttgctatttaatatgtgattagctaccagaagcatcaacatcacttgctagcttgttagaaatgcaaaatcttgagtctaactttagacctcatgtaccagaatgtgcattttaacaggctccctaggcagttcactttcacattaaaatttgaagcagaattctagaagaatggatacaactccacagagagttatagttaactatgaggcagatgttaaaaaatacaaatgtagtagaacagtagtttacagagatagttatgagttatttcccagtatttcaataaatttaaaatcttacttgaagttatgtatatttccaggtacctgcctgaatttcatgtcaccctggccattcagagaaagggaggtgaggaaggatggaggaagagtaaaacctcccaagtccttcacttaggtctcttgtactctggtgactcaactttcagtgtctcctgcctgccattcatctcttttattcatcaccaaccgcacccaagcccttgtcagagtctgatggctgcttccctctctgtcccatcaaatcctctggatggccagggtgttttatttgaaatacaccagtagttttttgcataacttttatacaacaaaagatttgtcctctagctttaataagtggctttttttcctactctaagaagcagcatgtgaagtaagtgggtactttgggagttagtcttggctatgtcctgctggacttgggcaagttatttacatttccaagactgtaatctattaaatgtggataacattgccttttcatggagttattgtaaattaaatgagatatgtgaatgtactagggacactggtgtccagtgttagtttccttttcttctgtggtttaagtgaagagggaaagaatagggaggaagagaaaggaggagagagactgtgactggatgagccacagtctgctttcctatagtaactatatacaactgtcttgatcaccagtgtatttctaatggttgacacagtgtctcttcctgaaaagtggttggcattaatatttgttgaatgaatacattaattttctgagggctgtctgcttgctttatgcactggagggtagaggaaaagttatatcacattaacttttcagcaggtcaaaaatgtgggttgcttaaattgaatgcagaatgtagagacagtggctaaggagcagacaagccaacccctgtggttggtgggaaaaacatacatgcagtgacaagggacccaggtgaaactaaatagtgtccctggaaggttatgccaggtggcaactttagctccctaaacttccatttactgaatcccttgcattttaattcctaacctcatcttccttttcagccaaaataaattttctcaaactagagttcttgcggccagaattgatgtatagttgatggaagggaaaagaaaatctatgtttggaatataaaaatgcagtgacccttgggaggcttctgaatccatccctgtttgtatgctcagatggcatgacttgctgtctcttgtggcttacttaggaatgagtaacacatgaataatcagcccactgttccaatgagctacttgtacagtactccaggaacaccaggcatttcttacagcttttattctctaaatcacatgatgataaatgttgttgttttttatcctgagataactatgaggcctggggcaggatgatgatgatgacctgtgctaagagcattccttcctgtttcagtcttccagcaaccaccaagcggggatataatgatgctttacacacatctgataaaaattatgatagtgttttgcttctttccttgtagatcaaaagaagacctacaattactatagcacattgtcatttacaactgacaaactatatgctgagtttggcagagaggcttctaacaattttacagaaatgagccagagacttgaatcaatggtaagcaacttgtcatctacttctagtgcatttgctttcactttttaccatatttttagcatcctagcttctaaaagatccattcaactaacggatccctgtgtatttgcaaaatgaaaagaggccctaacccaaggaatataaaacaaaatggacaatacatcacttagcacaatatgactcacagggttgaaccaaagaaactttagccattcggtcaggtccttcttactcacctttccttagctagtgatatactcttgatcagtagagtccagagattctggaaatgtgagtgtggcttaaaatatatttgttgtatcctagacttcctaaaaaagagaccccgagcagaagattgccaagattgaaactatttaggcacatacctaaatagtctgttaggttttaaaaatatctaaccttcaaccagcttttggtatataaatctgtagtaaatccacagatatgcaactctacccagtttttaaaaatatttaaccttcaactagcttttggtatgtaaatccacagataagcaactctacccttaacgcatcaacattcatcttgagggatcaattaaatacttaagaaactggaaaaattagcagcatgggccaaaagaacaagggcctaagtggtaacttcttgtcattatcagattaattaaagaataatttaacttttcctggaaacctgtgaggtaattcatgatataatgtgatggaaagaacactgaactgggagctgggaggcacatgtatctccaatggtatctactaggtaatgatacatcacttggaatattagtttatcattctgcacaaagttctgtaaattgaaaattaaggtattaggttagataatttccaaattgtcttccagttccaataacctgaataagaatggaagtgagaccctggaaaccgcccagtagacagaagcctggggatttggccaccttgctgagacagtggttgaatcctggttacatttgcacttgcaaacaccaaatcagggaaatatttgaccaggctcttctctaaggctaaatacatatgcaaaatgaaggaaatgaaattgaattaaaaaggtcaagaagagatgccactatttcccttgttctttgtgccattcattcaaataaattttatttaagtaaataaaatccagacagatttaaatctaaaggaatatacataaggctctttaatgccttcaaaattaataatagttttgaagttacttgacaaaaattaacccttaaataaaaattttcttgtgaatactgccatcctattcagaggacttctgctattcagctttgtctcataattgcaagaagtgtccttagtaaaaaaattcggaattaataaaatgtaagaaagaattaaaaggctcattgcttctgttaatcaccagcatgtagtaagtgtttactaaatatccacatactggaaacaagacacctttgagtgtttccttacataaactcctaattaaaaaattaagttgcctagaattcttatttagaataataactaacgtctctacaaaaatagactctttcactttagtagagtaaaactcataggtgtgttaggctaagtatcccagttcacctgggcctttttaagagcacttggagtgctgaacttcgtgtacattatgccaggaaaactgacaactttgtcactaggtttgggaagcatttgacatggtcatgcactcatttctataatccaagtattatgtggcagaattatttcatttcctttgtctatgggcagtaaaagtccttacttcagagtaaaatttctcactcttaattttgaagaaacagcatgttcattttctttggtctctttctgagcattagtacagcagatatcacttctggccccactgcggttccctactcctatcattcctaagacagcgttcagttgaaatcactgagaaaaccacaatagattcctcaagcttcctcagttccactcactgtgaaatgtcaatgttttttgctctgttttgttttttaattttctaaaaagctttgaattaatttgtggaatttcagaaagttgttcttgctgatatattttgaatatttttacaaacaggtgaaaaatgcattttataaatctccattaagggaagaatttgtcaagtctcaggttatcaagttcaggtatgtaaatctgaattgctgacttctgaatttaaagttgaagctgttaatctgctcagcaataaatatgttttcaagtgttaaagatataattcaatccaacaaacatttgacacttgtcctgtgtaagtcatgggttacaaagtcccttattcattccttaaatcccaaagtaagcatttgcaagatggttgctggggacagaggtataattggtgcctatgttataaaattgttttctgggaaacttaccaagtacagatagtactaaatacagatagacctaacacacatccttggtttaatggcaagtagtgccccatgtaagacaatatagtagatcaggtttgtctttagctcttcttcctcctattaatcaatcttctttatcttcttctattccatccctccattctcaaaatatgtagctgagaaaatctcatctgtcaactaaccattgataaatgggtttagtacataatgttaaggaaaatattataagaattttcaataagatattgacataatacaaattatttgtattaaaaaacagaataagaattatttccaatattattccaatgacaaaactttaaaagtttcctgccattctattacttagctgatatctctaaggcattactttgatcactgtcttctaaaaattctgtactctctggtgtttgagatactgccctttcttggatctgcaactacttctcttatctttaagtttcactttctcaaagggacctcattcacccacatggtctcatatgctattgaaatacaagtttctatctctagtctgaactatttttctgatttctataactatatacacatccccatgtggaagttccacagaaaattccctaactcaggaagaatccaatcacataaatgagaaacctggaagtcatcaaacactccttcctttcctggtcccctcatactttatgaataactaagttccactaattctattttcccaataactttccaatttgctcacctctttattccagtaatcttgctactgctactcattattctgtcttctgttactgcaatagtgagaagagcaagtttattggaaagatgaagtcaattttggagatgttgaatttacattctaagggaccatatgaacctgaaaaatgagggtgactcagtagagggaaatggaactgagcagaagatagaaatttgctcatgatcaactcaaaaatttggaagcatgggtgtaaatttctcagaaaaagaataataaaagggaatgaaaaggatgacaaagaaagcttgaagaccaatatttaaggtgatggaaggaatataggaaacttagatatagggaaagagcaggaaaatagaaaaatcatgacaaaatcaccactgatgcaaaagataagaagtttcaaagagagtgtggtcggcattgacaaatattcctgactgagtaatataaatattgaaaagaatccactggctttgtcaactaggatacttgggttgttacttattttcgtgtcctgaaaatagtgttacaattaacatgtttataggtatgtccttgcacaaatgtatgagtgcatttgaatgtttaatttctagaagtggaaatgctgtgccagagaagacagatattcaaacttataatagataacactgccatccaaaaataagactctaatttgtattcccacttccagtttatgagagtagtggttgatgcaatatatagtgaagagttagattcagaagtgactatgaaaaggagtgggtaaagtagctggcaggatgattccaaggtagtaattcatacaaatagtattaagactaattaatgctctgtgttgaaaatacagtcacatgaagtcagtacaatttggtaaagcggtcttatatctttaggattaggagttgtttaggatagcctgaagattgtttaggggaggtaagtagacttgagtcacaagaataaaacctgaaattcaaaaccacagttgatttcatatttaagacacactgtatttgataattttgaatggtttttgacaaggtgtctttttatattaatagccatatacttaactagaccttttgatggtaagggagaccatgaacagactaactcactatatgagaggctgaatttgtggttcttcacatagtaaacagtagcaatatagaaggaaacatttatggatgtattttatgtgtgcatttcatgtaagtgataaagaaaaaagcagattgtgatattacccttctttcttttcttttctcttttcttttctttctctctctctccctctctctccttcctcccctccattcccttctcttcacttcctttttcctttcccttctccttccttccttttctcttttctttctttcctccctccctcctttcttcacttcctccttccctccctccctccctcccttcctgcctttctttcttcttttcttttctttctttcattttcttcttttttggcccacagtcaacagaagcatggagtgttggctcatatgctgttgatttgtagatttcactctactgaggatcctgaaactgtagataaaattgttcaacttgttttacatgaaaagctgcaagatgctgtaggaccccctaaagtagatcctcactcagttaaaattaaaagtaagttaatttctcttatttttctttcatagaacagcttcatgttaggtttgatcttggcacttattaaaaaattttttttgatgtcctttaattctggggtcttgccaccaacagtatatttctttggaactaaatttgtcctaatgaagtattttaatttttaagactaccctaaacttaggcctcccatgcaagctttttattaactccttagcagttttctttatattacactttatagtttggctatagaatccaattataagtgaagaaaatggctttgtattttcttctttttcttgttgctttcattgtgtgttctgagggtgtggtatatggaaaggttcatgccatttacacatttgttttcaaatgtcattaatataccttgctatactttcttcccttaaacttttcaccagtgaaacatttataataaacttatttttggtatatttacaactataaatgaaaaatttaggtagatttttgttgttcttgttgttattgtttgtagggccacatgggacaaaacaagtgatgataggtcctcacatttagaaaataagaaatatgagatcctcagtggaaattaagatctggctaagggctggttcatatgttacagaacaatgaaggtctatagaaatactatctgggcacaagtataatgttacattttctagaagttacattaaaaataaaaataaacatgtaaaattaattttcaataatttgtatattcaacccaatatgtccaaagtattatcatttaaacaaatagtcaatgtaaaaattaattattcatcaaatatttcacttttttttgtagtaaggctctggaatctagcgtacattttatactgatagtacatttcaatttagactagccacactgcaaaagctcattggccacaggtggctagtggatacagtagtggatatggcagcactggaaactacagaataggggacaagtagagagaatgaatacaaactgctaatataatatctgatagatctaagtagatgcctaaattgatggccagccaacccacttgcttaggaaggaggcttcagtagtcagggacagatacataatttatgcgccttagcacaaaatgaaaatgctagacctgttttcaaaaagcaagaaaaaagtgctgttaaaagtacaaagatataacacttttctttcttccctggtctcgctctcgactttccatggtgttttcatttgctgattattgtcattctaagagaaaaaaattaaatttgtagattactaatatgagtttaattgtttatatcatgcaatgtcgatataaatgcatatataagtacatttaacttgtatttcaaatcatggaaattatgcaactatatttcgtagcttatacatacatgtttttcatttttgcctcaatggaaatagtacaaaaggctaatgactctttttattttcctggttaatatgagaaaattctaccaacactctctaccttcagcttattgaggggtgaggaaggactagaaggaaaaggagatctggatttccctatctttctctttctacattgtagttttcagcaaaagttgttggctaatacacagaagtaacagaagcaagaaaggatatggcaggatctgttgttcatttgtgtttattagaatgctattgtcttttctatgggttctaagcaagttttggttcaaacagaaaacatggcctccaaggcatgtcagtccacctctgcttacttaatggaagggatagcacacttaccttgtacttgctttgagtcttgctgaacccctgtggattgtgggtccactagaattctgatttcatagggaattgtgaatgatatatgcaaatggagtggaaagaaactatggacacacttattgcacatatcttgtctgccaacactataatccattatcctattgaacttcattttcaaaacacaagttacaagataaaattattaagaatgtcaagtgagcaatagcagagcattgtaccaagcacaaggccattgtgagtgtgagacccagtgcagatgtataagtcacacatgaagccagccttgtcagtgctatcaatactcagagcttgacattttcctaggaagagcttgagatagagaacaggttatttgaaacaaagagatcagaggtggtccttttaatattaactgagactaaattgtaaattcttccttatttttgccattttccccacaagtagccagaataaataaagtcagaaagaaggccttctagaatatagatttccacttcattcatactattaaatactaaagaaaaaaattaacactaataatatttttgcatttagagcatccatccttccatgtacaaagaatagttttggtcattagaactctgctgagtcagaaagtttgagcttagagttttatgtatctattagctgggttagtgtttgcatagggtttgagactgactagtgagaagtcagcaagctaagaagtcattggctggagctaaatgacaatttgagggcagactgtcttttgaaatttgacttcaaaaagggtaacattgtttttaactgtgagtgagtacaaatttatggagatgctactcaggtgtgttatacaaatgggactaggcttatgagctcaatgatacaatctgaaataatggttaataaaggtattgttacatttggggaattaatactatggtttagagtagtatttcccatggaggggctgtggactctctgcatcttatttactggtataaaatccaaattcttgggcgtcattacaagctactgaattagagttactgggaaggtgaacaggagtttcattataaatatgcttcctatgtgactcttacccacattaaagtttaacacaccgttcacattctctgcaatgtgatgatcatcctatgtctatgacaagctatgttgccttctttataatctagagatactgttttataataaaattaagcagccttttagtatttgaaatactcggaggcatagtgtaactctgatgtgctgaccctatttgccatttctgtgtgtttcagaaatcaacaagacagaaacagacagctatctaaaccattgtaagtttaatatatttattaaaatagcattacctgaaggtaaaaagctaacactataggtcatttaggtttactttgtgttgatatcatagggacagaacacataaagtttgattaatttgtgtacagttcatggtactttatcatatcttggagatacattttattagtaaaggatagcaaaattgagataactttggagtggatgtatgggtgcctgtggcagatgtgtagtggaattgagttgtacagctgttaaagaagaggcaagaaatgtttacttatcaatgttctgtttgtagatatctataagataaaacaaatctatacattgtgtttttcagctagaggcagaaactcattgtcactatatcctagataaaatcttcttgatgttattaatcctacggattaatacgaaagtgcaggaaattatcgggtcatggaagagtcacagaaagtgcaggaaattatggggtatattttaataaaattactgaagacacatagataatatcttcacctatattataaaagtgctgagtctaggcctagcatttttcttcgcctatagccaagtatgccaccatgatttacagtatacattcaatagttatggggttgttgcacattacatttctcttaaaaggtggaaaaatatgtgctactcaccagctcatatagttggttaatttctaaaatcaactaaacacaaaaccaaaagataatctcattacctaaatagcatatattctcaccaccaatatttattgggaacctaccatgtgctagcactgtgttagacaacaggcattccaaatggataagatataatatctctacctgaagcaccttatactttaatgggactaggtgcatgagactaattcatgaacacatcattcttaaacaacacttctcaaccaagggaaatattgttggccaagctatcatgccccactgtggcatttttgtcatgaatatagggggagggctactggcatctatagtggatctacagtatataggccaagatcttatgatgcacagggcagccccctacaacaaagaattaaatggttcaatatgttagtggtgccaaggttgaggaaccctgtcataaacaatgtcagtatgtatacatacacataagcacacatacagagtgtgtttgttatacacataagcacacacacagagtgtatttgttactattattattttggaagcaccaagaaagtaataactaatccagattggagacaggggagttagagaaagcatcctagagaggtaacaactgatttagattttacaaaatgaacaggagttagctaaataaaacactacagtttacagaaaggtaagagcatgagaaaacatttgatacttttggagcacaaagtagaagaaatatgggacatagtaacacaatttgatgtgcaaaacaactgctaattaatgcacccaccaatgcaccccccctctctcttttgcaggctgcggaacacgaagaagtaaaactctaggtcagagtctcaggatcgttggtgggacagaagtagaagagggtgaatggccctggcaggctagcctgcagtgggatgggagtcatcgctgtggagcaaccttaattaatgccacatggcttgtgagtgctgctcactgttttacaacgtaagtcttgaagcttgagaatgattgggagtgaacaaagtgcactgggttttggcaagaaaatacctcatgaattttgggagatatgagtttagcataaattaaaaatagtgtgtatatcacaaaagactggatcatttgtaaacattagtaagaggttttaaagtctggaaatggaaatggagtcaaagtatatgtaaataaataatcttttgataaacacacaatagtttctcaaagaaagcaggaattttaaagtcatttttggatttgaatttgctgtcaaacaggagtgctctatctctgctgagtaccttaatcagagatggagtctggataggttgtaggtttgatcctaagggggaaatttcacatggtaagaaaaagaattaaatacgaagaattatgtaatgaagatatgaagaatttggaagtagcaagttgtataaatgaatagattgactaattatattgcaagaaatggaggacccttcaatctattgtcaaaatgtctatagtatataaaataataatactttgttaaattattgtgtggactttttggttttcagagaaatgtgtatatttctgggtggggtacatgagacacatagaatatattaatttctcttattctgtacagggtactttccataggtcccttggagtcattaatatacagaaaaatcaaaaagccttagcatttggagtggatgacttggcatatggagtggcatgtatattataggaaatggtggctttttcacctggtcagaaccctgagccttattatcaaattggaaagagttctatacatcaaaactataaaaagaaaaaaaaatctacacctgtagactaaattatttaatataaattattcgactggtagcatggtaaaaagaaatttattcttcatttttttctccccagatataagaaccctgccagatggactgcttcctttggagtaacaataaaaccttcgaaaatgaaacggggtctccggagaataattgtccatgaaaaatacaaacacccatcacatgactatgatatttctcttgcagagctttctagccctgttccctacacaaatgcagtacatagagtttgtctccctgatgcatcctatgagtttcaaccaggtgatgtgatgtttgtgacaggatttggagcactgaaaaatgatggtgagcatcggaagaggaactcaagtaaaagttaaattggtattttatggcatttaagcaatgaaatgccattatgccaaaatatgttagttgtgtggtcatatgacctggaccaagtcaggccctaaaagtgaagtaaataacttggaaggcacaaaaattccttcctgcctaagttaatatcgagtaaattgctcctactatatactacagtcatagtactgctaagatgtctgaaaaagcaaatatgtctcctagccatgaactttctttagagaattaaccagtttagagattagcaatcaataatatacccaattctgaagattggagaatcataaagccaccattctcccctactgaaatttccttgtaatcttaacaatggagtggacattatttagataacttgtggttctttcctaggcacccaactttttgctcaaagtagttaggaacaaattatcttcccaaatattattgttctaaacatatgtagtctaagattctgtatcactatcttttttttttttttttgagacagagtctccttgttgagacagagtctccaggcagaagtgcaatggtgcgatcttggctcactgcaacctctgcctcacaggttcaagcgattctcctgcctcagcctccccagtgattgggactacaggtgcccgcctaatttttccatttttagtagagacagggtttcaccatgttggccaggctggtctcaaactcttgacctcaggtgatctgccctcctcggcctccgaaagtgctgggattacaggtgtaagccaccgcacccggtatcccccgctttttttttttttttttttttaagatggggcttctttctgtcccccaggctggagttcagtggcccgatcttggctcactgcaacctctgcctcccgggttcaagagatttacctgcatcagcctcctgaatagctgggattacaggtgcatgccaccacccccggctaatttttgtatttttagtagagacaggatttcaccatgttggccaagctggtcttgaactcctggcttcaagcgatcctccaatctcggcctctcaaagtgctgggattactggcgttagtcaccgtgcctggcctgtatcaccatcttattcctaatcatgaaacattttcttcaagtttataaaatatatgtatgtctacaaatacaaagacttttttttcttttaggttacagtcaaaatcatcttcgacaagcacaggtgactctcatagacgctacaacttgcaatgaacctcaagcttacaatgacgccataactcctagaatgttatgtgctggctccttagaaggaaaaacagatgcatgccaggtaaacagttttgcccattagtaggttgtgtaattttttgtttacttttctttgaaataattatatatctacaggaagttgcaaagatagtacagaggagtcacaacatctcacccagttttctccaatgattacatctcacataactatagttcaatataagatctgggaaactgacagtcgtacaaagtatgtgtctaattctatggcattttgtcacatctgtagatttgtgtaaccaccactacagttaagatgaagaactattctatcaccacaaagacctacctttttccctcctcctactatccctaacatctggcaatcactaatttattctccatctctataatttttcaattttcagaatgttatataaatagagtaacagtagctttttaaacagaatttaattttggatcatctattggtatttttggctttttgttgtagaaaaattttagtggttcctttaagttatatatatgtgtatataaatatatatttatttatatatacatacataacatcactgtctatgtgtattgaaattttactagttttggtggagtatagaataaaaaacttacttccccttaaatccctttgcttttccctctttaatattaaacattaacaaatataaacattaaatattaataaatataaatattaaatatttgctttatattttgagaaccacagaagacaatgttttgcttcaactgtcaaatgtaatttagaaaacataagaggaaaaggaaagactatttacctatggatttcttctttcctctttcctgattccttttttaaaaacagtcatttctgttttaggaacttcttttagccactcttttagtataggtatgctggtgaaaaattctcttagattttctttgtctctaacagtctttatttcttcttcattactggagcataatttagcactgacagttcttttctttcagcatttaaatcattgcctctgtgatttctgcaaggaatttgctgctattagaattatttttttccaatagatgaggtgtcatttcttgctgtgttcaagagtttgtctttagttttcagaagtttgattatgtatcttggcatggatttctttgggcttatcctgtttgaggtttgctcagctttttgaatatgtagatttatatcctttgtcaagtttgagaaatttttggtcattatttcttaaaatactctttcagtcccaccttctttcttctttccttctggaactctaaccacagcaatgtttactcttttattatagtcccagagtttcctaagcttttgtttattttttttgcactctagtttctctctgtttttgagattgggtaatttcaatgtatcttcaagtttactgattctttgctctgtcttctctattcttatgttaagcccgtccagtgagttttgaattttgcttatcatattttttagttccagggtttttctttgtttcttctttttatatttactatttctttgttgacacttcctatttcttttcctttgttttaaacatgatggtaattgctcattgagatgtatttatgatggctgctttaaaatctttgtcaaataatttcaacatttgtgttatctcagtgttggtatctgttgattgccttttctcattcaagtaaaaacttttatatttcattgtatgatgactgatattcagatatatgctgagcatctaattattatttattctgttttgttgttgttgttatatcatgcttttaaatttatattattttatttaattaattactttgcttcttccaacttttattttaggttcagaggttacatctgcaggattgttacatgggtaaattgtgtgttgctggggtttggtgtacaaattatttcatcatgcaggtagtaagcataataaccaataggtagtttttggttctcatcctcctcccaccctcaaccctcaagtaagccccagtatgtattgttcctctctttgtgtccatatgtactcaatgtttagcttccacttataagtgagaacatgaggtatttggttttctgttcctgcattcatttgcttagtataatggcctgtggctgcatccatattgctgcaaaaaccatggtttcattttgctttctggctccatagcattccatggggtatatttaccacattttctgtatccagtccactgttgatggacattttaggttgattccatgactattgtgacaattgctgccatgaacatatgcatacatgtgtctttatggcagaacaatttgtattcctttgtgtataatatacccagtaatgggattgctgggtcaaattgtagttctgtcttaatttctttgagaaatctccaagctgcttcccacagtggctgacctaatttacattcccacgagcagtgtataagcattcccttttctccacaacctcaacaacatctgttgtttttttgactttttagtaatagccattctgactggtttgagatggtatcttattatggtttttaatttcccatttccctgattagtgatgttgagcatttgtccatatgtttgttggctgcttgtgtgtcttcatttgagaagtgtctgttcctgtctgtattaggctgttcttacactgctataaaaaaatacctgggtcgggaatggtggctcatgcaggtaatctcagcactttgggaggccaagggaggtggatcactagagctcagaagttcaagaccagcttgggcaacatggggaaatcctgtctctgctagaaatacaaacattagccaatgtggtggtgtgtgcctgtagtcccagctacttggaaattatgaggcaggaggattgtttgaacccaagaggtcgaggctgcactgcacccactgcactccagcttgggtgacagagcaaaaccctgtctccaaaaacaaacaaacaaactaacaaaaccaagtaaacaaaaagccaatattaggtaatgtataaagagaaaaggtttaattggcttatgattctgcaggctttatgggcagcatggtgctggcatctgctcggtttctagggaggaagcttacaatcatggcagaaggtgaagtgtgaaatgggagggagcaggtacatcacatggtgaaagcaggagcaagagggatagaggtgccatacacttttaaacaatccgatctcacaagagctcactcactattgcaaagataactccaagccgtgagtgattggctcccatgacctgaacacctcccaccaggtcctaccttcagcattgggggtgacaaagcaacatgagatttgggcagggataaatatccaaattatatcattctgctcctggcctctcccaaatctcatgtcttctcacattgcaaaatataattatgccttcctaacagtccccaaaagtcttaactcattccgactttaactcaaaaattcaaagttggccagatgcagtggctcacacctataatcccagcattttggaaggccaaggtgggtggatttcttgagcccaggagtttgagaccagcctgggtaatgtggcaaaactgcatctccacaaaaaaaaaaaaaaaaaaaaaaaaaaaaaaaattagctgggctttgtggcatatgcctatagttccagctgtttgggaggctgaggtgggaagattgattgatcgtgggaggtttaggctgcattgagctgtgatcgcaccactgcagtccagcttgggtgacacagaaagacttcatcttggggaaaaaaaaaaagtctgaagtccaaagtctcatctgagataaagcaattcccttccacctcatcaatctggatttcactgtcgatgtaactatcagcattttggtcacaaccatttaaccagtttctaagaaatttcagacttgatcatatctgtcttctgagccttcaaaattcttccattctttacctgttacccagttgccaagtcgctttcacattttccaatatctttatagcaatgccacactcatagttaccaattttctgtgttaggctgttcttgcattgctattaagaaatatctgaggctgggtaatttattagaaaagatgtttaattggctcatggcttttcagactttatagtaagcctgatgctggcattaacttagctcctagggaggcatcaggaagcttataatcatggtgggaggtgaaaggggagcaggaacatcatgtggtgaaagcaggagcgagagagagagagagtgggaggaggtgccacacacttttaaacaaccagatatcgtgacagttcacttgctatcgcaaagacagcactatgctgtcagggatccgttacccaaacaactcccaccagcctcacttccagcaatggagattaaacttcaacatgagatttgagaggggacaaatattcaaactgtatctatgttttttttccccattttaaaagggagttgtttgttttttgcttgttgatttgtttaagatttcttaaagattctggatattagacctttgtcagatgcatagtttgcaaatattttttcctattctgtaggtcgtctgtttactctgttaatagtttattttcctgtgcagaagctctttagtttaattagatcccagttgtcaatttttgttttagttgcaattgcttttagggtctttgttataaaagctttgctaaggctgatgtccagaatggtagttcctaggttttcttctagagtttttatagttttaggttttacacttaagtatttcaaccatctcaagttgatttttgtatatggtgaaagaaaggggttcagttttaattttttgcatatggctagccagttatacccagcaccatttattgagtagggagtcctttccccatttcttgttatggtcagctttgtcaaagatgagatggttgtagacatgcagctttacttctggcttctctatttggttccattgatctatgtgtctactttttttgtactagcaccatgatcttctggttactatagctttgtggtatagtttgaagtctggtagtgtgatgccaccagctttgtttttttgtttaggattgctttggctattaaggctcttttttggttccatataaatattacaacagtttttactaattctgtgaaaaatgacattggtagttttataggaataacatttaatctgtaaatttctttgagcagtatggccattttaacaatactgattctttctattcatgaacacaaactgttttaccatttgtttgtgtcaactatggtttctttcttttttttcttgagacaaggtcttaccctgttgaccaggctggagtgcagtgccacaactatagttcactgcagccttgaactcctgggctcaagcgatcctcccacttcagtctcctgagtagcggggactataggcattcaccaccacacatggctaattttttagatttttggtagagatggagtcttgccatgttgctcatgctggtcttgaactcctgagctcaagcaatcctcctgcctctgcctcctaaagtgctgggattacgggcatcagccactgtacctggccttcaactatgatttctttcagcagtgtttttaattctcattgtagaggtccttcaccttcctagttagccatatgtctatgtattttattcttcttgtggcaattgtgaatgagattgcactcttgatttggctctcggctaagatgttaatgttgtatagaagtgctcctcattttagtacattgattttgtattcagaaactttactgaagttgtttatcagttctaggagcctttgggcagagactgtggagttttctgggtgtagaatcatatcatttgtgaagagagatagtttgacttcctctcttctatttggatgccttttatgtctttctcttgcctaattgctttggtcaaaacttccagtactatgttgaataacagtagtgagagtgcacatccttgtcttttctggttcacaggggaatgcttctagcttttgcccattcattatgatgttggttatggggttgtcatagaaggcttttattattttgaagtatgttcctctgatgcctagttagttcaaggtttttttcttttttttctttttgagacagagtctcgctttgtcacccaggctggagtgcagtggtgcgatctcagctcactgcaacctctgtcccccaggttctagtgattctcctgccttagcctcctgagtagctgggattacaggtgccaaccaccatgcctggctaatttttgtatttttagtagagatggggttttgccatgttggtcaggctggtcttgaacacttgacctcaggtgatccacacatctcggcctcccaaagtgctgggattacaggcatgagccaccgtgcccagccatatttatttattttcatatgttgaaccagccttgcatcctagaaaataagactacattactgtggtggataagctttttgatgtgctgctggatttggtttgcaagtattttgttgaggatttttgcatcaatgttcatcaaggatattgtcctgaagttttctctttttgttgtgtctcttccaggttttggtatcagaaaaacactgccttcataaaatgtgttagggaggcttctctttttctagaattttgggagtattttcaatataattggtaccagctcttctttatatatctggtagaatttggctgtgaatctctctgttccagggccttccttgttggctgtttttttaaaattactggttcaattttggaactcattatttatcttctcaggtattcaatttcttcctggttcaatattgggagtttgtgtttccaagaatttatccattccttctagattttctagtttgtgtgcacagaggtgtttacaatcatctttgaaattttttgtaaaaaatatttctcttccctttggcatttctgatggtgcttatttgaaagttctttcttttttttctttgttagtcttgctagcagtgtatcaatcttatttattctttcaaagaacaagttgtttggtttcattgatcttttatatggatttttgtgtctctatttcattcagttcagctctaattttggttatttttgtcttgtgctagtttaggggttcacttactcttgtttttctagttcctcaaggtgtgatgctacattgttaatttaagatatttatatcttttcgatgttggcattttgccccataaactttcctgttaatactgctttacctgtgtcccagaaattctggcatgttgtatctttattttcattaatttcaaagaatttcttgctttctgtcttaatttcattctttactcaaaagacattcaggagcaggctgtttaatttccatgtaattgtataattttgagagatcttggtattgatttctatttttattgcactgtggtctgagagtgtgattggaatgatttttaaaaatttgtttagaattgctttatggccaagtgcatggttgatcttagagtatgtgccatacatatgcagatgaaaagaatgtatattttcttgttgttaggtggagtgttctatagatatctcttaggttcatttggtcaagtgttgagtttaggttcggaatatctttgttagttttctgcctttataacacctttagaggggtgttgaaatctccactataattttgtatttatctaagtcttttttgtaggctctaagaacttattttctgagtctggatgctccagtgttggatgcatatacatttagatagttaatcttcttgttgaattgaacactttatcactttgttacaccattttttgtcctttttaattattgttttaaagtctgttttgtctgaaataagagtagcaacccctgttcttttttgtttttcatttgcttggtagatctttccttatgcctttactttgagactatgagtgtcattgcatttgagatgggtctcctgatgatagcatacagttgggtcttgcttctttatccaatgggctactctgtcccttgtaagtggggcattaagcctgtttatattcaagttataatattgatatgtgaagatttgatcctgccatcatgttgctagctggttattccacaggcttgattgtatagttgcatatagtgtcagtggactatgtaattgtcttttctgtggtgtcaggaatttttttttttttttgagaccgcgttttgctcttgttgctcaggctggagtgcaaaggtgcaatctgagctcactacatcctctacctcctgggttcaagcgattcttctgccttagcctcctgagtacctgggattacaaatgcatgccattacacctggctaattttgtatttttagtagagatgggatttcgctatgttggccaggctggtcttgaactcctggcctcaggtgatctgcccacctcggccttccaaagtgctgggattacaggcgtgagaaaccatgcctagccaggtaatggtcttttgttgccatgtttagcactctcttaaggactttttgcaaggcaagtctggtggtaataaattcccttaacatttgcttgtctgaaaaagattccgtttctccttcgcttatgaagcttagtttggctggatatgaaattcttgattggaatttttttctttaagaatgctgaatataccagcctggccaacatggtgaaaccccatctctactaaaaatacaaaaattagccaggcatgctaatgggcgcctgtaatcccagctattcgggaggctgaggcaggagaattgctttcacctgagaggcagaggttacagtgagctgagatcatatcattgcgctccagcctgggtgacaagggtgagactctgtctcaaaaaaaaaaaaaaaaaaaaaaaagaatgctggctgagtataggtccccaatctcttttggcttataaggtttctgctgaaggttctgctgttatcctgatatcaccccctttgtatgtgacctgtccctttgctctactgcttttaagattttttctttcatgttgaccttggagaatctgacgacaaggcgtctggaggatgggtgtcttgtatgttatatctctggggttctctgaatttcttgaatttgtatgttaacctctgcagcaagattggggaaattttcaggaacgatattcataaatgagttttccaagttgcttgctctctctctttccttggggatgccagtgaattgtagatttggtatatttatataattccatatttcttggagattttgttcattaaagaatatctttttctttatctaactgagttgatttgaagaactggccttcaagttctaaaattgttttcagtttgatctgttctgctgttaatactgcccattgtattatgaaattcttgtagtgagtttttcagctctaggagatcagtttctcttcttttctttccttttttcttttctctcttctcttctcttcttttctctcagagtctcactcggttgcccaggctggagtgcagtggcaagatatcggctcactgcaagctccgcctcccgggttaatgccattctcctgcctcagcctcctgagtagctgggattacaggggcccgccaccatgcccggctaatttttttgtatttttaatagagacggggtttcaccgtgttagccaggatggtttcgatctcctgacctcgtgatctacccaccttcggcctcccaaagtgctgggattacaggcgtgagccaccgcgcccgaccctgattctttcttaaaatggcaatttcatctttcagctcttgtgttattttattgatgccataagttccttagactgtgtttcaactttcccctgaatcttgatgatcttcattgacatctgtattctgaattccatgtctgtcatttcagtctggttatgaaccattgctggggagctagttcagtcatttggaggtaagaagacactcttgcttttagagttaccagagttcttgcattggttctttctcatctgtgtgtgtgaagttgttgtcctttgtatggagctttttacttttatattctttgatgccttttgtggtttgattgtggtattagttgtgcttagttaatttcattcgtttttggatgatttcaggggtccaagggttagctcagcactcctgggctgcatgctgtaccaggctgtaaccttgggaaattgggaccaggtctgaggcggttttctctagcccctagaggttaagtacctcctgggttggaaggaatgaggtgttcctggtccactggcaacaaaactgtgctggcaaaggcactttggcggggtggcagtgggtcagtgagggtccttgtgctcacatacgtgctggtcgtggggtagtggcaagtcctgcacaggcatgcgtgctggtggtggggcagtgatggggtcagtgtgcatgcatacaccagtgagtcagtggctggaggctgcaggcaaaggcatgacagcaaagcagcaggtagaggctgccagtgagtgcatgctggtgggcgctcactgacagggacctgccttcaggagctctccagctgttaggcagggtctgccatcaaaatagcaatggctgtggctgtcaaaaaatgccttggctgggcagctgaggcagtgctgcaagtttgtgtagccaggcagggaatttggcataggccagcagacaagcgagtgcttggatcagattgttcccatcccacaagcaagagagccctgtgatgtccaggtctgtccatcaacaaaggcgaaagccacctagagatgtatgatatttgggggatgggcacccatgccatgctctgctgtagccattctcatgccaaaccctgtggactctgtgcaggctagaattctgtctctttcaactctccaggctgttctccctgccaccttaactgtccatgggggatgaggggtctcctgcagctaagattctggaggtctgtggtgtgagttggccactccatgaccatttaacttactccttccccaggagcctctccaggccaggaacaagttctggtgcttggcaaccctgtgcagggttaccagcttccttccctttcagcctggggtctgcattctccttccatcaactctcaatgccttctttctgaaaatttgttcagagtgtgccagtcttcttgatggtctggtccctcactgggagaaggtcttcttgtctgcgtctggtcggccattttgttttagtatttattaaataatgaaataataataatttgaaaaaattaaattattattatttaaaactctagatcttatttaaattttctatttaaccatgcctcagcagacattgtgatgcagagggagggggatgtatgaaggaattgcctcatttcccactcagcttcctttgatgctcaggtgagggactaatgctcattactactgcatggaggttaggcctcttctgataacactctggctgaaggtactttgttactgctccccttttggcctccactgacatcatggggtagtgatttcattactgcttcgcagtggtgaaagacttgacttcccactacctctcctcagacatggttctagtagatggggagagttattcctcattactgggtggtagttcatgcttcccactcagcatattcttttttttttttttttttttttttttgaggtggagtctcgcttgttgcccaggctggagtgcagtggtgccatcttggctcactgcaacctctgcctcctaggttccagcaattctcctgcctcagcctcctgagtagctgagattaaaggcatgtgccacgacacctgactaatttttgtatttttagtagagacggcgttttgccatgtttgctaggctggtctgaaactcctgatttcaggtcatccacctgcttcagccttccaacgtgctgggattacgagtgtgagccactgcacctggtgcctattcagcatattctgacaccaatctagtagggaattgggccttcttacagcctggtaagcatggaagtcttttcagttgggatttattgtcttcctggatttgctgttttcccaagttgtcctcttattgattattttactagggagagcaggattttcttggagccttttaaaaaacttgcacttgttggcaggttgccaggttgctggcttcttccaagtccatgatatatgaagcaaaaaaaaaaaaaaaaaaaaaaaaattgagagagctcactcttgtatcattccttttgtcctgcatttctgagcccacctgtcgtcttctctctaattttcagagtctttttatgtttgttttatttgtaatgcccaggtatttttttgtttgttttagccatatttagctggggaaaaaagaataagtaagtctgtcccatattggtctggagcgtttacatatttttgaagccgggttttgttttccagtgtttggctattgccaccaattttgtgcctttggtggatacaaaaattttgacctctatgtcttcatgtgcatcactcacaaaatcatggagggggccaataactggttccttctgtgtgtcactaaatgctttcataattttcattttgtgatttgacagaatttttgtttaatgtgctttctaagccctatagttctcttcagaattccatgttactctgtgtgctttctaatctgtattcataaaatggtaccattaatttctaagatttttttttacaatttttaatgttattcctttcatgctttcgcatgaacactatctgtattgccttcatttgctccacctcatttaattccctgttggcatcactatagttctttcccaacttttacctttgggttagtcgttttagcaatgttcagtttgctacattaaattcttttattcagttgacctttgtttatactctggcaaatgcccaagtttagactcacttcattttgtttctttttctgtgtttcctaattgctcctggaggaacacacggaacaaagtagattggtcccattaccacacactactaaaaattccttcctaacaattgaaattgattctgtaattcaatctcctgaaatgaattcaacttaaaagatgacttgaaaatatacttgatccttgttatttgcagattccatatttgcaaattcacctactcactaaaatttatttgtaacccccaaatcaatactcaaggcacttttatgatcattcacaagcatgcacagagtggcaaaatatcttattactcaatgagcatattcttacctgaggttgaaaaatgtgatactgtgcctttttgtttcagttctcattctgtaaacaagtgtcttttcttggtctacatagtgctacatttttcacatttttattatctttgctggcgattttgctgtttaaaatagtccccaactgtagtgccaaagtatagtgcaagaaggttgtgatgtgccatatggagaaaatatgtatatttggtaagctttgtttagttataagttttagcggtgtttactgtgagtttaatgttaatgaatcaacaatgtatattaaatagaacgtctttaaacagaaacacacacgaaatctgtttatgtcttgagcagttgacaaaaatgtgaccagagtctcctggaaaaccaaccctgtatttctcctaagaacaaggactcaacagtcattaattcagcatttgtggtgacttcacagaacacgactaccatgaataatgagaataacctgtattttatttgtcttcttgacggtcatggaatcattgatggtttagatattatgctagaccttcttttgtcctaatcatcatcatcctacttgcctccaactttcctgaaactgttgaaaacatcgtgcacttttacatttatgatcatccattattttctttattcaactatctcggtttctatagtctctatagtaatgtccttcctaaaaatttcagagaaacagatgtatgccctcttaatcttttattttataatttttattataaaaatttcaatggtatgcaaaaatagggaggataaaataatgaactttcatgtactcatcacctagttcaaaaatttacaactcatggccaaccttacgttatccgtacataccctgataaaatcccctcatcccctttccctaccaaaatatcaaatctattttgaagttaatcccagatgttatatactttcatctgaaaatgtccccattcaaaaatactattttgatggtgatattagaggtacacgctttacaaactttgtgagctacagaagagaagccaaatttgccctatgattacaatattctactttcttatctctgggaagacatggcacccatttttttgggggggagggatggagtttcatgcttgttacccaggctggagtgcagtggtgtgatctcggctcactgcaacctccaccttctggatttaagctattctctcgcctcagcctcctgagtagctgagattacaggcaaccgccaccacaccagactaatttttgtatttttagtagagacaaggtttcaccatgttggtgaaaaattccttcctagcttccaggctggtctcaagctcctgacctcaggagatctacctgcctcagcttcccaaggtgctgggattacaggtgtaagccatcttgcccagcctccatttaaaaaatgttcatgtctagcatccacagtttttaccacttgccttgctctttatattttaatatcacaaaaaccactaataacctcatatgtaaaaatttttccttgaatctcctactgtttctcatctcagtggtatttggcgaccttgcctttcttaagacatatcccttgtttgaatttcataattctgaaatttgctgatttctttcctcctcctccatctactcatttctggctgtatcctttgattaatctttctctctctctctcaatctggctatgctcaagattcagatctcagataaagtttttatctgctgtctatattctcactcaaagaagccatcttttctttgaactcagctatcaccttaatgagtgccaaacctgtgtctccagaattcaactcttgcccatatttagtcttacatttctacctacttcaaagtgatttctatttatatattttaagttcttaataggaaatgaaaatttgtatatgtgccatttgaaactcaacaggcatcatgaaatgttgcctgggtttttaagtttctcgctcatattattagggttcactattagagttttttttactcttatgtttcctccacatgtattcagttaagtcctagactattttcccactttaccatatcttttatgtttatttcttatgcccctattatttctgttaacaccctaatctattccctcatttctttgtgtcttaatacttccacggcttcctgtttggcttcttccaattttagaagtttctgaatacacttcctgttctgtttctcactaaaccattcactaaaaataacaggattaatgagacaaatagagatagagacagactggtccctcaaaagctatgcaactttataactgaagaattaacaaatataataattggtacctttaaaaatagcttgcacagtgtaggcaggcaaaacgcccaaagtctggtggcttactcagggcatgttaaaaatgcaaagaaaaataatgtggaaacacaggtttgctggtgctaaggcaatatacacagggaagtgtagtcctgagcagaagaggaaatgcaacctaaaactgatacaaagctaggatacatctctctggggagggagttttgggtacaggcactcaggcattttcttaaaacagtgccccaaatgtgtctgcctgtgtaatagctgagttgaaagggttttccttttcttctgaagtttataattccactcccattattctggctcccttgcctaaaaaaaagcatatctaaaccatcataatttccatcttctactgacataactctgccattcactaatcaaatgtgagctaattagtgctggtagaatagactctatatttttttctatttgatacttgctggacatcaccttacttttcagcttgtaatgctatttactgctatttatatactattatttatattatttactatttgtatactgctatctctttaaaataattatttattctcggactcatttattcctgtctcttatgctgattaaagctttgttttctcttgtatcttctatttctctatcctgattttctctgcctgcatatagacttgggattttattatcaaaattatttatttttgaatagcttcatatggcatatcttatttctataagcagattgcaggtttctagaggacaagatccatgtgtttataatactctttttatatctcctcctacatacgagggtatcagtaaatgcttattggttagttgatttaaaatcacaaatgtattatttcaaatttactattatattagttaattttttaaatggacaaaagaaaattcacaaggaagttagcataacgtagggaaaaaagcatgggcttctgaattagatcgctctggattcaaattcggggtctgccactgattagcacgtgatctcaggcaaattacttaatgtttctgagtttcagttttcttagtaacccagaaaaaattaacctagttctatgttttttgtaaacaagaattacatgaattaatgagataatattttaatcaattaagaacttcatagagtgagtatgaatacttaatgggtggtcaataattagaagcgccaggatcttgaggaataatcagccagtacctcattattacaagccatataaagaatcaaaactctggagtttgcaggatataaataatgagaatttgtgattttatatatgcatttcctaagttctgccttttgctagactaagcactttacattcactgtcttacatcatcttcatagcactcatcacaggtaggtattattaggagcatttacagataaataaattaaaggtcttagccagcatggaaaggccaaacttgagatagaaaccctggtgtctgactctaatgtctgtttttttttgtttgtttgtttttttaaaatcagtaatagactcttcactcccttttttggggggttatgttacactaataaagagtatagacaaaataattagggagttattttgtcagatgtgtcacataagttaagagtacagttcttcaaagagatggaggcttcaatctcattgttttgaaggtttcaaggtatttcaaggtttcaaggtttcaatctcatcagttttcaaggtattggaggtcctcttttaggtggataactgacatagatggagaaaatcacttatgcatgcgaacacacggaatacttttgaaaattacccctttcattacattcttaagttagaaaaatagccaattcctctgtaatgaactgaattatgaattactaatttctgtcttctcctttagggtgactctggaggaccactggttagttcagatgctagagatatctggtaccttgctggaatagtgagctggggagatgaatgtgcgaaacccaacaagcctggtgtttatactagagttacggccttgcgggactggattacttcaaaaactggtatctaagagagaaaagcctcatggaacagataacatttttttttgttttttgggtgtggaggccatttttagagatacagaattggagaagacttgcaaaacagctagatttgactgatctcaataaactgtttgcttgatgcatgtattttcttcccagctctgttccgcacataagcatcctgcttctgccagatcaactctgtcatctgtgagcaatagttgaaactttatgtacatagagaaatagataatacaatattacattacagcctgtattcatttgttctctagaagttttgtcagaattttgacttgttgacataaatttgtaatgcatatatacaatttgaagcactccttttcttcagttcctcagctcctctcatttcagcaaatatccattttcaaggtgcagaacaaggagtgaaagaaaatataagaagaaaaaaatcccctacattttattggcacagaaaagtattaggtgtttttcttagtggaatattagaaatgatcatattcattatgaaaggtcaagcaaagacagcagaataccaatcacttcatcatttaggaagtatgggaactaagttaaggaaatccagaaagaagccaagatatatccttattttcatttccaaacaactactatgataaatgtgaagaagattctgtttttttgtgacctataataattatacaaacttcatgcaatgtacttgttctaagcaaattaaagcaaatatttatttaacattgttactgaggatgtcaacatataacaataaaatataaatcacccatttgcttgacattatgatatgataatccacaaagaaggggaagatgggaaaaatgttactagtcaatttattgtaaatttttttaaaatttgaggctaggatgaaaattaatttaataacaatcagcatgcttatgtactaaaataattgtgttgtggaatgggagggaacgaagagttcaaacaattgactggaaaggttttattcatctaagactttcccaaacagcaaatccttgaagggaatgagatccaggtgttagtgtacagtctagtcatgcaactgaactggggctcagacctctattttgagatgattgtagatatttttcttcccctgctgctgtgtttacagttcatacatggttaatggtcctgttagactcctcttcgctgagatggaaagataccatagagaaaatatcctggaagctgcctcactgctgcatctagtgtgacactgaatggctaactgcctggataacaaaactgaagagtaaaagcatgatattggccaccttcatgatttttagttttggtaaattattactgagctgttagagacacagctttcaagtaatccagaccgtaatgaagttaggactggtaccatgatgtacggcatgttaatggtgagatttcaccaagtctgtcctcattgcatatagctactcatataagttctatattgtacaataattaccctgaaaaccagtattgccacgaaaaatttaagtttattgatctgaataacactggagtatgaactgataacatttaggcacttggcaaaaatatgaaaactgacatgaattgatagtgctaaatattttgcataagctatttttgtttcatttagcaaaatgctctgggaaaaaacaaaattgaggaaaaccttgaattttaagcaaggatataagtacctttaaaactactctcagtgttctgttaaaaatggattcctcttgtttcagtgtattctgtagttgggcctctaggtggcacccacaagctgtaggaagctatggggaagcctgacatcaagaaggatgtctagatctgtaagtaataatgagaactgtacctgaaattagagtctcgtgaaaccaaaagaatacagtttttctttgcaaatggcgtttaaaaattaattcgtgttgatttacatcattattcgtatttttcaaatttctggacatttgattccaaactaaaataaaatttatgttgcatgatttgaggaactccctctgcaaaagcacctggagcaatttaaattaagaagaaattttaaaagcttaattttgcaatgacatcttattcctaagagaaatacttttgatatttccttctacaaaggatttgagaaatagaagtttgggtcaaagtgaaaatatgagcgatagttcaaactttatgtacatagagaaataggtaatacatttctaaaatggtaacttcttttgaaaagtaattaccaaagggttttatctgcatgtctgtgttaactgtttcattggagatagttaagaagatgtgacgataatatttattacttttttcaagagggcaggcagttcctcttctatatcttcgatctctcttcctacagcactagtaaagtactctgtatataacagtccttcaataaatgttgttgaatgactcttttatttttacattatgcagaaaacatagctttattattatttacacattgatttttaaaagtaatcccagattttacactgagtgaattaagccggttactatttatctaagcctataatctcacccgtaagatagagatgatatttgctcaaatgattgttgtggaaataaaactgtgaatgtttaaaaagtgcttagcacagttcttggaacattagtaggtgttcaagagaccatagtaataataactgttgctataatgaaactacactcttgttttaaaaaatatggtatttgattataacaggctgaataccttttttttttgaaatgacaagataattagaccaacaaaatgtgctagttaaaaaaatttctgattctacaaaaagttttactgggataattccgaaacatatttatcaaagtggtctgtcaatgtgagggttcattctaacttttgacttcaattttaaaaaatgataaactttattaaccaccgagtggctggattatatcaagatctatggtgtagttcaaatgtcgcctcttccctgaagcctttttttacttcctcaagtggatgtactatacgtttcttctgaacttccttaccattaattttttttattttcagataatcattgattcagatacggttaagatataactgtaagatataattcacagagattctgtgtaccctttactcagtttacctcaatagtaagatcttgcttaggtgtagtataatattacaatgaagaagttgacattgagacaatccattaactttattaggatgcaatcaattatatatgtgtgtgtaggtgtgtgtgtaattagttctatgtaatttaattacatatgtagattcatgtgattaccaagatacagatagtttgttcacaaggctacatcacgctaccgacagccatccagctccctccctaggcctgtgtctagtctctaatccctggcaaccactaatctgctctccatctttataatttttattgtttcaagaatggtatataaatatattatacaatatgtaactttttcaggttggctttttcgctcagtataattttcttgagatctgtccaagttgttgtgtgtgtcagtagttaattctttttttattactgagtagtattacatgatagggctgtacctcagtttgttaactgtatacccactgaagggcatttggattgttctcaggttttggctattacaaataaagctgctatgaagatttgtgtgtaagcttttgtgtggacataagttttatttttctgagatttatggcctagagtatgctgggtcatacggtaagtacatgtttagatttttaagaaacggccatattcttttcacatggctccttactacttgtaaaactctctgtacttagaatatctacctgtgtatttcacatgtgcagacagatgtgatttcaacaactagactgtaaactccatgagggtggggacactaactggttcatttttatatccttcacagttcacaggaaactataatattgtttatggcagttgttctataaagatttattaaataaaaataaagagtaataaaagcaaacaaataaatatacgtgaaataaaaaagaagaaatggctttgggtagaaaagaatgaacagtatttccttcatgaaggtattactgctcaatttctgtaattctgcatggactctaccatggcacttccatgtatcttatgttggttgatataaagtctgtttttcacctttccacagggtacacaatcaaacatagactaaagacatggttgatatggagaatctttatacctgaatttagtttctgatacatgttatatttaagagttttctgacacatctgtatcagcttctactgtatttgtggaatggattccagtttaggagcacaatcaataaatatttgttgctcttactttttataactatgattctataatttgtcctaatgtaatttttattatataactcaaggtggagtgaaagacagagacctgtgaaatgtaatcagaagttctctcttaattgtctctaacacattaatcagtacctctttggcgtagatgtagtcagcttaaattttacaatcactgtactcactgccttgcatatacccctcacctgcttgttctcttgctccaccactctgtgacacttgctttttactatgatcctggtaaaatttaactctccacttactgtttttaaaaactaattaatttcccccaattttattaaagtataattggctaataaaaattgtatatagttacagtgtaaaatttgatgttttgatatatgtatacattgtgaaattatttaatcaagctaattaatatattcattacctcaatacttactattttttaaaagaacatttaatatctattcagcaatatctacttttaacaatttaaaaatactcaatacattattattaactgtagtctccatgctgtaaataggcctccagaacttatttcttctatataactgaaactttgtaccttttaatcaatatcttctcatttctaccacactccagcctctagcaaccaccattttactctctgcttctattagttcagctttcttagattccacatataagtgagatcatgtagtaatcagcactctgtgtttggcttatttcacttaacataatatcctccagattcatctatgttgtcacaaatgacacgattcccttcgtttttaaagctgtatcatattccaatgtgtgtatttctttattcttccaccaatggacatgtaggttgattctatattttggctattgtgaataatgctacaataaacatgagaatacaagtatttctgtaccaaaagtgaaaaacagaatggttgtatggtacttaaagtatggtttctactgaatatttcaattaatcactgctgagataaccaaaatagtgtgtaaaaaacaagcaaatcagcaaaaccaaaattgcactttttcaaaatgtcagataaatgactaatcttttaactagactgaactcccataaaggagatgattcacattttaataataaagtcagatataatagtaaagacattattaccaatcatacagaaataaaagaattataattgtatattaggagcactggtatgtcaacaaattataataacttaaatgaaatgaacaaatctctaaaagacacagtcatacagactcaagagttctaacacaattccattatgttcaaaggacacacttcgtatgatttcagtacttttattgagagacacggcctagcaatggcctatcttggaaaatgttaatgtacttgagaatattatatacagtcatgcattgcttaacaacagggatatatgaactgcattgttacatgattttgttgtgtgaacatcatacagtgtacttacataaatctacagggtgtagcctactacacacctaggctgtatggcataatctattgctcctaacttacaacctgtacagcatattactatactgaatactacagggaattgtaacacagtgggaagcatttgtgtatttaaacataactatacgtagaaaagttactgtacaaatacaatcatctaaaaaattaaaaaatggtatacctgttaaaattcttatcatgaatggagttttcagggctagaagttgctctgggtgagtcagtgagtgagtggtgaatgaatgtgaaggcataggacattattatacactaccgtagactttataaacaccatgcacttaggctacactaaatttgtaaacaattttccctcttcaatgaaaaatcaactttagcttactgtaacccttttaatttataaactttaaatttcttttactttttgactcttttataatagcacttagcttaaaaacaaacatatttttcagccatacaaaaatattttttctttatacccttattctataagctttttaaaatattttaataatttattattttttacctttaaactttttggttaaaaactaagagcccaccacagctcagcaaggccactgtggccagactgactctctagattccctcctctctgggcagaacatctctgaaaaaaaggcagcagccccagtcagggacttatagataaaacccccacctcctgggacagagcagctgggggaaggggtggttgtgggcacagcttcagcagacttaaatgttcctacctggcagctctgaagacagcagtggatctcccagcacagcgttcaagctctgataagggacagcctgcctcctcaagtgggtcactgacccccgtgtatcctgactgggagacacctcccagtagaggccgacagacacctcatacaggagagctctggctgacatctggtgggtgctcctctgggacaaagcttccagaggaaggaacaagcagcaatttttgctgttctgtagcctccgctagtgatagccaggcaaacaggttctggagtggacctccagcaaactccagcagacctgcagcagagggccctgaatgttagagggaaaactaacaaacagaaaggaatagtatcgacatcaacaaaaaggatgtccactcagagaccccatcggaaagtcactgacttcaaagaccaaaggtagataaatccacgaagatggggagaaacaagtgcaaaaaggctgaaaatccaaaaaccagaatgcctcctctcctccaaaggatcacaactcctcaccagcaagggaacaaaatgggatggagaatgagtttgatgaattgacagaagtaggcttcagaaggtgggtaataacaaactcctccgagctaaaggagcatgttctaacccaatgcaaggaagctaagaaccttgaaaaaaggttagatgaattgctaactagaataaacagtttagagaagagcataaatgacctgatagagctgaaaaacacagcaggagaacttcatgaagcatacgcaagtatcaatagctgaaccaatcaagcagaagaaaggatatcagagattgaagatcaactcaatgaaataaagcaagaagacaagattagagcaaaaagagtgaaaagaaaagaacaaagcatccaagaaatataggactatgtgaaaagaccaaatctatgtgtgattggtgtacctgaaagtgatggagagaatggaaccaagttggaaaacactcttcaggatattatccaggagaactttcccaacctagcaaggcaggccaacattcaaattcaggaaatacagagatcaccacaaagatattcctggagaagagcaaccccaagacacataattgtcagattcaccaaggttgaagtgaaggaaaaaaatgttaagggcagccagagagaaacgttgggttacccacaaagggaagccaatcagactaacagcagatctctctgcagaaaccctacaagccagaagagagtgggggccaatattcaacattcttaaaaaaattttcaacccagaatttcatatccagacaaactaagtttcctaagcgaaggagaaataaaatcctttacagaaaaggaaatactgagagatttttgtcaccaccaggcctgccctacaggagctcctgcagtagtttctgctgccttttgttcagctatgacctgccaccagaggtggagtctacagaggtaggcagggctccttgagctgcagtgggctccacccagttcaagcttcctggctgctttgtttacctactcaagcctcagcaatggcgaatgcccctcccacagccagtctgccaccttgcagttctatctcagactgctgtgctagcagtgagcaaggctctgtgggcatgggacccgctgagccagggccgggatataatctcctggtgtgctgtttgctgagaccattggaaaaggtgggagtgtcccaattttcctggtagagtctgtcatggcttcccctggctaggaaatggaaatcccccaaccccttgcacttccagggtgaggtgatgccccaccctgcttcagcttgccttctgtgggctgcacccactacccaaccagtcccagtaggatgaaccaggtacctcagttgaaaatgcagaaatcacccatcttctgcattgatcatgctgggagctgcagaccagagctgttcctatttggccatcttggttcttcactatagacatgttacaaaggaagatatacaagcagtcaacaagcatatgaacaaaaagatcaatatcactgatcattagggaaatgcaaattgaaaccacagtgagataccactgatcattagataaatgcaaatcaaaaccacagtgagatactatttcacacaagttagagtggctataattagtcaaaaaatagcagatactggtgaggttgcagagaaaagggaacacttatacactgttggtgggagcgtaaattagttcaaccattgtggaaagaggtgtggtgattactcaaaaagctaaaagcagaactaccatttgacccagcagtcctgttactggatatatgcccaaaggaatatatatcattctaccataaagacacatgtacatttatgttcattgcagcactgttcacaatagcaaagacatggaatcaacctaaatgcccatcaatggtagactggataaagaatatgtggtacatatacaccatgggatgctatgcagccataaaaaagaatgagatcatgtcctttgcaggaacatggatggaactggagaccatcatccttagcaaactaacacaggaacagaaaaccaaatgctgcatgtactcacttatgagggggagctaactgatgagaacacatggatgcaaagagacaacagacactggggtctacttgagggtggagggttggggagaagaataggatcagaaaaaataactattgggtcctaggctttgtacctgggtgatgaagtagtctgcacaacaaactcccatgacaggagatcacctatattagaagcctgcacttttacccctgaacctaaactataagtttttttttaaaaaaaatcttaagaaagaaacataaagtcaaacgttttgtgaatattatgtcaaaattatgtgcttatcattttgctgctgttccttttttaaaaatgctttttttatctctctgtaaaataatggtgttccctttctaatgcaaacatactttcagatcctaatcattggggtaaacattctttttaaaactattgtttacaaaagtaaaaatctgactttgtccatgcagatcatctattgacaagtatttttcaacaacataattttaaccttatgacatcagttttaatagcagtcattacactattattccaggtgattctgggacacctgagtactctgtgtaattgaagttatctgtagccacatttaatatgacatgttcaatgtttggtctcacaagctcactgcttagagtcttcttcatccacccaatattgaagtaatgaaatggctgttaatagattcatcactgatctcattctgcgacatctttatcagaataatataaaatcaatgtaagaaatttggtgaaattatgaaaatttaggaaaaaataaatttcatttataaaatctgtgtgctttcattatggttttattctatttatataactcaaagtacatatattatgtttacataaaaattttttatctcattgcatgtatcttttcttctgacacaaaaattgtgatatttttctgttcatcattttgttccgtagtattcaacaatacctgtactatggctgacagtgtaatttaacattttttgataaaacaattgtaatgacatggtacacacattgtatacattttaaatcatttctcaatgtaaaatatttgaattgtctccagtgtttattttatgaatgtctgccacaaatattgaatctgaccatcgtgatttaggtgttctctgtatagtttcatatgagtatattatgaagccaatgtctatatgcatttttataatacttaatacttttccccaagtgtctgattcttttaaaatatgcaatcattatctgagaatctaatacataatggaaaagcaagaaaatttgtgacaaaaattattttatgtaagaaagaagtagaggacaggctgcacaactattgacctggattcgaacctaccttctgcaaatgaataacaacagctagtattagtatttatcactattgttctaatagtcattcttgcccttgtcttccttctccacctactctcttcccccttctaatggcaccatcactttcctctaatgtgaatgggaaaattttttgagaataaggttagagtgcatagaattttcattggtcttacctctgcctttgtcctttgggaaattaccacatagagcctatgcaattttcattcaacataaacattgagttttaactcaagtaagatttcagttttctgttgctgcttataagaaggtagacaaaaagatctcttaaggcttatataataaagtagtgaggaatgcttgctttctgcttatgtctcaaaagaataacattaaagtaaaatatatgaggttcttttgtttcttcgtaaggaagatcatcctatatcctgacagaattcttttgtaaatctcagtgtagttttcagatgcaagtggtagacattatttggatcttattatacatgcattgttcatttttttttggtgcttctctgtcaggcagctgtgatgatgagtcccaagtttcccagagatttttactgaggtgtcctataggcttggtataaggcagaaaacattaaaagggtaaactgacccttttatgctctaagatataaacctctgtcatctcactgactaatgttttaaatgctagagtgaaagcaagtaaacattggctttggctgtgaatattctggtggcacacatttatgtcgttgatgaatagtgtaccttgaaaagccttaacccttacgccgttagcatttcatcttgttcatctgactgcccaaacatctatatttaaacaaatccacaggggatctgttctctaggactttgctggagaaccttgatgtgtcggaaaactgttcctattaatagaggaattatatctcgagtggctggcatatgttaactaatggatactattaatagtaataacaaaaataaaaaatcattacaatattactactatttgaatcactgactatgtatgagagacattataagtgttttatctatgttaagtatatttccaacacgacacaataggaggtaattgccattattatagaagtaggcataattatctctatcaacattctagtccacttttccatcattatctgttgcataaactcatgcaaaatcttctaaatgatctacacttttcacaatctggcctttttgcgatgtaatccattgacaacattgagagctttttaaagaaagggaatctgataatatctctccatttctgaactctgtgcagtagctcccctttgcccttaatagatacttagatctccttatagttatattgcttcaacttacctctctagcatcatctgctactttactcagctttttcctgcatactaatttgaaaccttaggcactgcctttacttcactacctgcttttctttttgtgttttcctctccccctcatcttttcatctactcctagacattattgaggactcactttatcaatgactttgagatctcttctacatgtttccttagcattgtgaccttataacacttttagacttttcctttttacttgcttatagtctatctttcaaagtacaacgtaaggcatgagggagcagaaagtgcctacatttcttctctgaaaatccagcacttatccgtggtttgtgctgatcaattcataaatattccttgaaggaatgacttatttttttttttacattgcacaatgaaggctttcattgaatcaaccctgttttcagagtctctttagtatccctctttgatatttaatgacactaaagtttacacagttgtgatgatatagcaacatatgagtttctaatggtaggtcactttctttgacctcccgtatttctctcactgtgagtcaaacactctgaatgaaaacatatctggccattccttctgaaatgcaaagcaaataaatcaaacatgaatacatttaccttaggcagggttttggctggtttacagtggagttcccccacaaaatcgacatttggtaagggtgggtgaagaaattcaaaatcccagtacgtttgaatgagccacacttcagctttccccattgtctcaaataatgtacattaataaaataaatatatacatatatttttatatataagcataacaattttatatattgcatattacttatatataaggaaagcaaaatgttcagagaattaagaggaaattacatatatttttttctttttcttttttttattatactttaagttttagggtacatgtgcacattgtgcaggttagttacatatgtatacatgtgccatgctggtgcactgcacccactaactcgtcatctagcattaggtatatctcccaatgctatccctgccccctgcccctaccccaccacagtccccagagtgtgatattccccttcctgtgtccatgtgatctcattgttcaattcccacctatgagtgagaatatgtggtgtttggttttttgttcttgcgatagtttactgagaatgatgatttccaatttcatccatgtccctacaaaggacatgaactcatcattttttatggctgcatagtattccatggtatatatgtgccacattttcttaatccagtctatcattgttggacatttgggttggttccaagtctttgctattgtgaataatgtcacaataaacatacgtgtgcatgtgtctttatagcagtatgatttttagtcctttgggtatatacccagtaatgggatggctgggtcaaatggtatttctagttctagatccctgaggaattgccacactgacttccacaatggttgaactagtttacagtcccaccaacagtgtaaaagtgttcctatttctccacatcctctccagcacctgttttttcctgactttttaatgattgccattctaactggtgtgagatggtatctcattgtggttttgatttgcatttctctgatggccagtgatgatgagcattttttcatgtcttttttggctgcataaatgtcttcttttgagaagtgtctgttcatgtcctttgcccactttttgatggggttgtttgtttttttcttgtaaatttgtttgagttcattgtagattctggatattagccctttgtcagttgagtaggttgcaaaaattttctcccattctgtaggttgcctgttcactctgatggtagtttcttttgctgtgcagaagctctttagtttaattagatcccatttgtcaattttggcttttcttgccattgcttttggtgttttagacatgaagtccttgcccatgcctatgtcctgaatggtaatgcctagattttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttgtgttccattgatctatatctctgttttggtaccagtaccatgctgttttggttactgtagccttgtagtatagtttgaagtcaggtagcgtgatgcctccagctttgttcttttggcttaggattgacttggtgatgcgggctcttttttggttccatatgaactttaaagtagttttttccaattctgtgaagaaaggcattggtagcttgatggggatggcattgcatctgtaaattaccttgggcagtatggccattttcacgatatcgattcttcctacccatgagcagggaatgttcttccatttgtttgtatcctcttttatttccttgagcagtggtttgcagttctccttgaagaggtccttcatatcccttgtaatttggattcctaggtatttaattctctttgaagcaattgtgaatgggagttcactcatgatttggctctctgtttgtctgttgttggtgtataagaatgcttgtgattttggtacattgattttgtatcctgagactttgctaaagttgcttatcagcttaaggagattttgggctgagacaatggggttttctagatatacaatcatgtcttctgcaaacagggacaatttgacttcctcttttcctaattgaataccctttatttccttctcctgcctcattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgtgtatattgaaccagccttgcatcccagggatgaagcccacttgatcatggtggatacgctttttgatgtgctgctggattcgatttggcagtattttattgaggatttttgcatcaatgttcatcaaggatattggtctaaaattctcttttttggttgtgtctctgcctggctttggtattagaatgatgctggcctcataaaatgagttagggaggattccctctttttctattgattggaatagtttcagaaggaatggtaccagttcctccttgtacctctggtagaattcggctgtgaatccatctggtcctggactcttttttgttggtaagctattgattattgccataatttcagatcctgttattggtctattcagagattcaccttcttcctggtttagtcttgggagagtgtatgtgtcgaggaatttatccatttcttctagattttctagtttatttgcgtagaggtgtttgtagtattctctgatggtagtttgtatttctgtgggatcagtggtgatatcccctttatcattttttattgcgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttattttaattgtgatgttagggtgtcaattttggatctttcctgctttctcttgtgggcatttagtgctataaatttccctctacacactgctttaaatgcgtcccagagattctggtatgttgtgtctttgttctcattggtttcaaagaacatctttatttctgccttcattttgttatgtacccagtagtcattcaggagcaggttgttcagtttccatgtagttgagcggttttgagtgagattcttaatcctgagttctactttgattgtactgtggtctgagagatagtttgttgtaatttctgttcttttacatttgctgaggagagctttacttccaagtacgtggtcaattttggaataggtgtggtgtggtgctgaaaaaaatgtatattctgttgatttggggtggagagttttgtagatgtctattaggtccgcttggtgcagagctgagttcaattcctgggtatccttgttgactttctctctcgttgatctgtctaatgttgacagtggggtgttaaagtctcccattattaatgtgtgggagtctaagtctctttgtaggtcacttaggacttgctttatgaatctgggtgctcctgtattgggtgcatgtatatttaggatagttagctcttcttgttgaattgatccctttaccattatgtaatgaccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgggatgggtttcctgaatacagcacactgatgggtcttgactttttatccaatttgccagtctgtgtcttttaattggagcatttagtccatttacatttaaagttaatattgttatgtgtgaatttgatcctgtcattatgatgttagctggttattttgctagttagttgatgcagtttcttcctagtctcaatggtctttacattttggcatgattttgcagcagctggtaccggttgttcctttccatgtttagcatttccttcaggagctcttttagggcaggactggtggtgacaaaatctttcagcatttgcttgtctgtaaagtattttatttctccttcacttatgaaacttagtttggctggatatgaaattctgggttgaaaattcttttctttaagaatgttgagtattggcccccactctcttctggcttgtagggtttctgccgagagatccactgttagtctgatgggcttccctttgagggtaagcccacccttctctctgtctgcccttaacatttttttcttcatttcaactttggtgaatctgacaattatgtgtcttggagttgctcttctcgaggagtatctttgtggcgttctttgtatttcctgaatctgaatgttggcctgccttgctagattggggaagttctcctggataataccctgcagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtgttggttattctagttatacattcttctaaatttttttcaaagttttcaacttatttgcctttggtttgaatgtcctcccgtacctcagagtaatttgatcgtctgaagccttcttctctcagctcgtcaaagtcattctccatccagctttgttccgttgctggtgaggaactatgttcctttggaggaggagaggcgctctgctttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccccaccgtgtgaggtgtcagtgtgcccctgctgcggggtgcctctcagttaggctgcttgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtctgtgccctgcccccagaggtggagcctacagaggcaggcaggcctccttgagctgtggtgggctccacccagttcgagcttccctgttgctttgtttacctaagcaagcctgggcaatggcgggcgcccctcccccagcctcactgccaccttgcagtttgatctcagactgctgtgctagcaatcagcgagactccatgggcgtaggaccctccgatccaggtgcgggatataatctcgtggtgcaccattttttaagcccgtcggaaaagcccagtatttgggtgggagtgacccgattttccaggtacgtccctcacccctttctttgactcggaaagggaactccctgaccccttgtgcttcccaagtgaggcattgcctcgccctgctttggctcacgcatggtacgcgcacccactgacctgtgcccactgtctggcactccctagtgagatgaacccggtacctcagatggaaatgcagaaatcacctgtcttctgcgtcgctcacactgggagctgtagacctgagctgttcctattcggccatcttcggaaattacatatttaatgtaacattagtatattcacaatctcaaatagttattaaaataagccactatggacttaaatatgcatttgtttcctctctgaaactgcagtagtaactgatatacatttaaacagctctttgagctccaggatgaattcatcttactatactcataaaaacagctttctacgaagtgcacaatctcgtttccacaatttatcaagtcagtcccttgatccttggttctccaagtgaactgtgagttttctgagagtatgcctgaaatccttgaacatactactgcttctagttcacgttaagattttaacaatattagctttaaaatacatacattaaaaatgatagctagtatattttcagaatttattgaaacagagatatgtgctcccccttaacttggcccatattttccctaataaagagatgtagttaataaagtatagattaaaagcttgaatgttcactttcaacaagattttaattcacaaagcaaataatttctcagttgttagtgaatgatatacaaacactagaaacctcaaattttaggtttctgtttctgaaatagagccagtatacctctcaactgtgaaggaatccttctgtttatagagaaaaatattttaatacctaaataagaaaactgaggtacacaaagagaaacaagtttctcaatgctgcattgatagttatgctagaaatatgtgtagctcctcatctaaatgtctgccttcatcaagttgtttattgatatatgttttgccttttttaaagatgaaaaaagtatagtaaaatacgtatatagttgcttaaagaaatcataagtgctttactttgtagtttttttttttttaattcctgtagtgtcctataggagtgatgaccaaagggttctagctgagcctataatatcaacatttctataatatttgtgagattgatagatcatcttacatttggcattcatcatttcatttaaacaacactatcctcttacattatatttatatacgctcaccttcaaaggcaaaaggaaagttaggacttattaatcattgattagaaacatgacttacctagaacttcactgtaaaacttctcccacttctcgtatcaaacatttgaaaccaaaagtcaaaataaagcacatgtattagatttttaatcctctccacgaatgtcattttaccacttaattcagacagaacagcaggtatgcgggaaatggggaatggaagtcctccattatacttctcaagtgtgtagccaggagactgtcaacaaaggacatgtatttaacatgcctttaacatgctcagctagcagttcaccacaggcaccaagggcatctgcaagaacgacatcaaactttgactcttgtagttttgtcgtaattttcttgttcaaaactacatctttacagagattattaacacagtctgtagattcccaaaagagttcttgtgcttgtgaaaaatatgaccaaaatgcatcttttggaagatcgtatatccatctattgatcagtttcacaacaagaccctcaaaattatttttaattagagatgttggataaacttcaaatttaatagcagatgatttactagggtcaataataatggaagccgaagatgtcaacacagtcatcttgtggcctctccaaacaagttcatccaggattgtctttatattcatccaatggctgtattctgtgggccacagcagcacctttccacaactcccagagctaaagtaacaactgagttgtatcaggagaatatttgacatcgatttcaatgtcctcctggtgcaatgcaatgtttcttttcaaattgctgtttctttctgtctttctcatacttacatctgagcataaatcaatcaagtgaaagtataactgctacaattcaaagtagcagttaccatataatttctaaattatcataggaattgtctgttaccatacaatttctaaattaccataggaattttcagattgtttttcacagtggttgcttccatttccattctcaccagcaatgtataagaattttaatttcttcccaacattgccaacacttgggattacatttcgtttgattatagccagtgtgaatgaagtgatatctcattatgctttacctttccttgatatgaaatcatgttgagaatgttttgcctagttttgattgaattatttgtcttcttatggacttgtgtttttaatatttttgatgtaagaaccttatcacatgtatgatttccttgtatttttttattctttgggctgtccttttactttcttaatggtgttaattgaagcacaaaagtattgattttaatgaagtccaactaatcaattttaatttggttgcttttatttttgattttatatctcacaaaccatttccaagttatgaaaattagtacctgttatttattattagagttttatagttctagtgcttacatttaagtttttgatcacctatgaattagcttttgtaagtgatttgaggtagagggtcccaacttaattattttgtatacagataatcatttttcccacttatatttgttgaataatctattctttcccctattaaaacgttttgaaacttttgtcaaaaactttaaatgcatgggcatatttctatgttctaaaatcattccattgatctacatgtctatctgtaggcctgtatcacactctcttgattatcatatatttgtatttgtctttaaaggcaggaaatgtaagttttccagcttttttttatttaaattgtttcagttttttttttaatttttttcttcttgtttttttttttttttttttaagagatagaagtcttactatattgcccaggctagattcaaatttctgggctcaagcaatcctcccaacacagcttcttgagtagctggaattacaggtgtgtttcactatacctagcttcttttggctattagtatgtctcttgaatatgtacataaatttcaggatcagtttgtctgtttatacaaagaagcaatctgggattttgatacggattgcattgatttggtatatcagtttggggagtagagtatggtcattatcacaattttaggtctttcaataaatgaaaatgagatgcctttctatttatttagatgttcttatttccacagtgttttgtagattttgttacagtggctagctagtcagacacaaacagggcagaagagggctcccacaccctaccaggaaagtcaggtgaccatcagttaatggccaggcagttgtcacactgtttaaaacaataattggttgcagccagccagggaaaggcagatttcttatagatagaaaaaatcaaatctggtaatcagcagcttcctgataagatctcagcagttgggagagtgggttcacacacacacattaagaggccaaatggtggagtacgacattccgggggcaccagaaaagggaagaatgcctcaggggagcatgcatatgactccagtaaatatactgtgcatgctcatctcctaagtggtagcaggccatcacacatgccagcaggtcattctaaggaaagaatcaaggaaaagggaagcaggacccggaaagtatgccaacatataaaaccctaagtcaaaggtcaaacaccacactttaccttcaaaatggctacttgtatctatcccaagtgtactttcctttctttcctgctataaaactttttaataaattttcacttctgttctgaaacttgtgctggtctctttttctgccttatgccgctcagtcaaattcattcttctgaggaggcaagaattcaggttgctgcagaaccataaatacttgctgcagtaaccaccgctggtaataatgtcacagtaagagttgtacaattttttgataaacttattgctaagaattatattttttcatggtattataggggtgactgtgtaatctttattttagtttaaatttccattgcaattgtgtagattttttgtttgtttatttaccttgtatcccaaaatcttgttttattagtttacttgaatattttttagtggatttgtaaaaattttctattataagatcatgatatatgccaatagagacagtttaacttctttctttctaatgtggattccttttatttcattttctttcctatttgttggctgaaagttctactgcaatattgagtgaaagtgagaagagtcagtttagtgtgatgttagctgtgtgtttttttatagacactattgatcagttttagaatgttcccctttacttctagtttaagtgttcttatcatgaagaatattgaatttcattaagtaagtttttctgcagttatcgaaatgattatgcagttttttcctttattctaatgatatgatatattagttggctttttcagatgttaacataactttgcattcctggaataaagttcatttgtttatggcatttaagcttttcatgtgttcctgaattttgtttgctagtgtgaaaagaaagtaaaaatcttgagtcattaaactcactatgtcaaagagaaaagttaatcttgggaaatgaagcatgtaaaattggctcccattttgttcctaaacagatagctgcaaagatagaaggccacatacctccccagatggcctccttcccaatttactcacaaggaaattcacaaggccctaaaacagagttctcttgaattttaccctgacaatataaattaacattttatattcacaggtatataaaagacaggacttgaagccattgtgtggtttttagcataagggcttactgaatggtggttatgttttctcctcttttattttttggagaattagttattttaaatacttgatagaagtatagagcttttatattttctactctaccatttccagttattacccagctatgtttttctaaataatatttcattggaagccgtcagacactgggcttttcttttatgggagactttttcttacagcttcaatcttgttacttgttattagtttgttcaggttttttatttcttcatgggtctattttggccggttgtatgtgtccaggaatttattaatatcatctaggttttccaaattgttggtatatagttgttcataatattctgtaataatttgtgtttctgtaatctcagtttttatgtctcctctttcacttctgattttatttagtgggtctgttctcactttttcttacttagtctagctaacagtttgttgattttgtttacttttacagagtttaccttattgactatggctgcttttgtactacaatggaagagttgagtaggcacaggagtccaaagggtttgcaaattccaaaaatgtttaccatctgaggctttatagaacctattctgatctctgctctacagtaagcaggttcgttttttcctttaacctttctatatattcaatgcaattttactaaaacagtatagatttttagtgagtgagccagatggtttacgtttaattttgttaataattagttaataaattaatctatttgtatttccattttatttagaataggtgaatttgtttattatgtggaatggtgcttctgttttgccttttttttttgagaaatctctaaactgctttccacagtagttcaactaatttgcattccaccaacagtgtataagcatttccttttctctggatcctcaccagcatatggttttttttttttttttttactttttaataatagctgttatgactagtgcgagatggtctcattgtgattttgatttgcatttctatgatgattagtgatgttgagcatttttgtcatatgtttgttggttccttgtatgtcatcctttgagaagtacctgttcacatcttttgcccagtttttcatagggttacttgatttttgcttgttgaattattcaagtttcttatagattctggatattagacctttaacagatgtgtagcttgctaatatattcttccattcaataggttgtttgtttattctcttgatagtctgctgtgcagaagctcttcagtttacatctcacttgtgaattttgagttttgttgcaattgctattgaggacttagttataaattctttcccaaggctgatgtctagaatggtatttcctagattttcttcaattattcttatagctttaggtcttatatttaaacatttaatccatcatgggttaatttttgcatggtgaaaagtagaggtccagttttgttcttttccttatggctagcaagctatcccaccatcgtttattgaatagggagtccttttctcctttgcttatttttgttgacttagtgatggatgactataggtctgttgctgtatttctgggctctgtattctgtttcattgatttatgtgtctgtttttgtaacagaaccatgctgttttggtatctgcagccttatagtttgaagttgggtaatgtgatgcctctggctttgttctctttgcccaggcatgcttcagctatttggactaacttttggttttatggaaatttttgaatatttttttctaattctgtgaataatgacattggcattttaataggaatagcatttaatgtgtggatggctttggttaggatggttattttaatgatactgattcttccagccttgagcataaaatgttctaccatttgtttgagtcatctatgatttatttcagcagtgctttgtagttcttgtagaaatcttttgtctcctcggttagatgtatttttaagtatattttgtttatgtgactggtgtaaatgtgattttgttcttgatttgattctcagcctgaattcttattggtgtatagaaatggtattgatttttgtacattgattttgcatcttgaaaccctactgaagtcatttttcagttctagcaggctttaggcagtctttaggattttctaggtatagaatcatatcatcaggaaagagagataccttcaattcttttcctgtttggatgccttttatagctttctcttgcctaagtgctcaattagtacattattgaaatagaaagtgctgttattttaatcatttatatttgaaacataaaatttaaaaaatgtattagcctatgttaagtccaaattcattgcggaaatgtactcatccacctaataataataatagttgtagcaaattgaatattactatatacagcaattacttacagcaactcttttagcctcagcaatgctattaagtaggtagtgccattgcctcatctccatttcactgaaggagaatgtgaggcatagacctgataagtaatttgcttaaccataagtgattctgtaatggttttgcaaagatgatataggttatctggattcagagtgcaagctcttacccaccatcctatgctgactactctttctgggttacaggtagttacaaaatgtaacatagaatcacatttttttcgtacgtatatattaattataatattattacaggtgtatgattcaaatatgtaaaaatatttttctggttgtctatcactgcttaaccaactgctctcaaatgaaggtgcttagaacagcaacattttatcatcgcctgttttaattctaggttgttggccaggctcaattaggtgtttatggcacagcatttctcaactggttactgtcctaaggtagcttaggctaatcatctgaaggttaatcactcacatatctggtaattagtattaaaagtctcaagctactggagtgctggaccaattgtgacttcttaggcatacatatgtatttctacaccaaatggtatatttctcctggggactgtggatatggcacagggctccaaagtgagtggagagaccgagagaaaggaaaaaaaatgacagaaacacagagaaaaggacagaaggacagacagagaaaatgtattcacaacttttttgagctttggaagttaagctcctcacttccactatattctcttttttaagacagccacaaagtttgctaaatttcacaggaagggtatatgacttgattagaggattgccaatgcatttgtaatcacatcccaaaattactgcaaatataaccttaaaaattagaagaaatcactaaattactatagaattcataaaatgttgacataagacagtaaaatttaaaaaaattttgtatttaaattttaaccatgattaaaaattttaattaacattctaatatatttattcataaatatttaaaatatcaagtaggtgtccaaaaacaatctgtaaatttatcagatagagagtaccagattcctggtcaatttaagttttctaaatggcactaatagattgataatattatattaaaacctaagaacatgctatctcaaatcaatgtttatttcactaattaatttttaaaactatataattaaatataaaaacaaatttgtgcaaggttagtgaatgaagtatgtagaatcaaaattaaaagtagaatcctctatgtttatacagatttacagattcttaattttatttcaaagaagtatactcatttttttctggaacttgtttttcatttagcaatgtgatgtggagaacattccctgatattgtctgtaatatgcctgttctctgtaattacttcataccttctactttttgtgggaggtatgtatgtgcactgactgatagccatgtaagtgatggagggaacaacctgtacatacacgcactcaggtgcaagtgtatctggatagcagatgactagatgtagaattgcagagtcaaactctaagtataattttttttgtaagggttatttcactttatactctctcacaaactcttttctcaggttcttatgtttgatcaatcttctgtgggaaaataattcattgactttttatggctacatagtaatccatggtgtatacatactgcactttccttattcagtctatcattgatggacatttaggttgatttcatgtctttgctattgtgaatagtgttgtaatcaacatatatgtgcatgtgtctttataatagaatgattatattcctttgggtatatacccagtaatgggattgctgggtcaaatggtatttctgtcattaggtcttggaacagacaaccaaatgctgcatgttctcacttacaagtggaagctaaataatgagaacacctggaacacatgaacaacacacactggggcctattggagggtagaaggtgggaggggggagaggatcaagaaaaataagtagtgggttctgggcttaatacctgggtgatgacacatatttgcctatgtaacaaacttgcacatgtacccctgaacttaaaagttaaaaaagttcattgacttaacattattgacttaataaattataatgtccaattttctagtacaagtagcttttgtcatctttttgatgtgattggccatttttacttctgtgaattgtcaattcatatccttcatctattttcatattggtctgtttgtctttttggttggtgatatataatagctctcattgtacaagggataccagtcctttgtctacgtattgcaggataggcttgatgtaaattactttaggttggtatgcatgatgtaacaatattatctgctatgacactatatttattcaatatttcttaaaaatgtttcatttatctggatacattttataaaaattctgctgcaatctcttccaataattcccttagcatcaaagttttaatttatttttagaatacattcatgccataggtcatagagtggttgttgtgagacttggatgatggtcttcttgccaataaagacacaaaggtttttgttaacccatactactttgatcacaaagtgtttccttgatgtgtagcttttaggagggccttgagaattcctgagattttattatttgccatttttttggtaatttttgtgttcttgatattattactgattatgattagttgcaatatgtttacattaaaaatgattatcttatttttagtcatgctaaatgacttatgttttcatattagtgttatgggatgaatagagctacaggcttctgtggaaagagagaaacatgagacatccttatataaaatagggttatatagaataatggtcacttttaactgtcttctacaaacacattcagtttcacaaacatctgtaaggtagctcaataattctgtgccttgttttggaagaagtgaacacatatatacatgtacagttgtgataatcaaaatcggtaagtccccttaaagtgctggttctatattatcacaacctacaattcagacatttaatccactattaacgtttataaatgaccgtgaaagcaaccagttcacactttagaaaagttcatggggaaaagacaattagcttgtgaacaaaggttttcccaaatagttaaattttgtagtatttgtcaggtaggagtcattctatctctaatttgtcatatattgtgcttttgatccttgaacaacatggaggtttgaactgaacctctgattatatgcagattttcttttgcctctgccagcctgagataacaaggccaacttctctttctcttcctcctttgcctacttaatgtgaatacatgaagaagaaaacctttgtgatgatccacttccacttaataaatagtaaacatatttaaccttccttgtgattttcttaataacattttcttttgtctatcttactttattgtaaaactatgatatacaatacatatagcatgcacaatatgtgttaatttactgtttatgttattggtaaggcttctggccaacagtaaactatctgtagttaaattttgtggagtcaaaagttataaatggctttttgatggtgtgataggagagatttgcccgtaggtccactgctgttcacaggtcaactttactgcaaaatgatttaagttggcagaagccaaatgcactgccatatttttttagaaaagaggtgatgttgtagccggatgcacattaaggactagcagcattacttgtctccaaaccacagaggaatatggtggtcccagattttcagttttgttccccaactccatgtatctgagtcccattattttgctcttcaggccctaaatgtggcataaagtgtagtagaggcggacagtgtcgtctcctgtgcatcactgttgttttgcgatgaaattctcaatgtggtcagctgctgctgctgcagaagtcgattttcttcaaacactgccaagaacatctgacttacatagcatattttgatttgatatttattcaaactgagccttttttctttttacaagctctctgaaactgttaaaagtcttcactttataaactatgtagttaccatgatctttatactgttggtaaagcaatgattcactttccccgtgtctttcacctcagttcttttcttccctgtgtgaattgtatccattttgatcaaagtgattttactgaataccaggagttatcacctctcaagtgttgttggcaaggagactgtttttgccagttatcagtgagttattaaattccaaagtcccattttgagggtctgctttttagtgccacttgcccaagctgccatagtctatttttctcagaaagcaaagcctgagataagaattagtgtgcaataactaatttgagaaatgttcttagggtacaggagtaggggacaggaaagggtgaaacaagaagggagaaaagtcagtacaagaatgtgttaccaaactaatcatcaccgtgactgttgggacttaagctcatgtggacccagtaggaagctgtgtggatgtaaggcgtgatcattaaccatcactttctattgttcacactgccaggttatgcacatgtgagtgagtgttagctgagtttctttgacggttccatgaagagatgttaaagaagactggtgcagaaaatgagagacctgtcctatcagaagatgactttacaaagctccttgacacagcaaaggctagagaaaaaaaaattagctgaaaaatatggggtgcaacctaatttgatcaaatgtattagagctttcttttttcttttgtttcattttcacagtatattacatttcatatgattgaatactgtaaattttctcagttttctgataaagttatgtctgtgatacaggaactagaaagaaattattcaggcagatagtgagggtgagagtcctcggtaaggttttgttttaataaaaagcagctccgcaaatcatttccttgctaacaaaaagcagcctgaaaaatcaagcttcaaacatagagaaacaagctaaaagcttgcataggtagggaaaagaaagagagatcagactgttactgtgtctatgtagaaagggaagacataagagactccattttgaaaaagacctgtactttaaacaattgctttgctgagatgttgttaatttgtagctttgccccagccactttgccccagccactttgacccaacctggagctcacaaaaacatgtgttgtatgaaatcaaggtttaagggatctaggactgtgcaggacatgcctttttaacaaaatgtttacaggcagtatacttggtaaaagtcatcaccattctctagtctcaataaaccaggggcacaatgcactgcggaaagccgcagggacctctgcccttgaaagctgggtactgtccaaggtttctctccatgtgatagtctgaaatatggcctcatgggatgagaaagacctggctgtcccccagcctgacacccgtaaagggtctgtgctgaggtggagtagtagaagaggaaagcctcttgcagtcgagatagaggaaggccactatctcccgcctgcccctgggaactgaatgtctcagtataaaatccgattgtacatttcttcaattctgagatgagagaaaaaaaccaccctatggtgggaggtgagacatgtttgcagcaatgctgccttgttattttttactccactgagatgtttgggtggagagaaacataaatctggcttacgtgcacgtccagtcatagtaccttcccttgaacttaattatgacatagattctattgctcacatgtttgttgctgaccttctccttattatcaccctgctctcctactacattccttcctgctgaaataatgaagataataatcaataaaaactgagggaactcagagaccggtgctggtgcagatccttggtatgctgagtgctggtccactgggcctactgttgtttctctatattttgtctctgtgtctcatttctctttctcagtctctcatcccacctgactagaaatacccacaggtgtggagggtcaggccaccccttcacttgctaacaaaaagcagcctgaaaaatcaagcttcaaacatagataaacaagctaaaagcttgcataagtaaatgctggcaactgtgccaataattcctcaaggatctagaactagaaataccatttgacacagcaatcccattactggatatatacccaaaggattctaaatcattctactataaagacacatgcacacatatgtttattgcagcactattcacaatagcaaagacttggagccaacccaaatgtccatcaatgatagactggataaagaaaacgtggcacatatacaccatggaatactatgcatccataaaaaagatgagttcatgtcctttgcagggacatggatgaagctggaaaccatcattttcagcaaactaacacaagaacagaaaaccaaacaccaattgttctcactcataagtgggagttgaacaatgagatcacatagacacagggaggggaacatcacacactggggcccgttgaggtgtgggggactaggggagggatagcatcaggagaaatatctaatggaggtgatgggttgatggttgcagcaaaccactgtggcacatgtatgcctatgtaacaaaactgcatattctgcacatgtaccccagaacttaaagtataattaaaaaaaaaaaaaagaaagaaaagggatgggataccttgaagccaggtatattcaacagggaggttccctctttcctttcctttgtcaaccacacgtgcaataaagaagcaggcaacatggcactggccaggtagagaaagcatatgcataatagaagattagggtggggcagcaagcttcttcttacactatgtaaatggcacccctggttccaccaatcctttgggccctatataaatcagacactgcttcctcaagcttgtctataaaacccagtgcatttcgccatggaactagaagatctatttgggatcacctttctgcaggaaagagagctattctcttttctctttctttcccctattaaacctccattcttaaactcacttctcgtgtgtccgtgttttcagtttccctggagtgagatgatgagtcttgggtatttaccccagacaatgatgctgcttaacctgttacttttatttattcttacttgaaaaatttttatttattttttatttattttacttaaattctgtgatacatgtacagaacgtgcaggtttgttacctaggtacacatgtgccattgtggtttgctgcacccatcgacccatcatctaggttttaagccctgcgtgcattaggtatttgttctaatgctctctgtctccttgtcccagaccccctgacaggctccagtgtgtgatgttcccctctgtgtctatgtgttctcattgttcaactcccatttataagtgagaacatgcagcatttggttttctgttcctttgttagtttgctgagaatgatggtttctatccacatccctgcaaaggacatgaactcatgcttttttatggctgcatagtattccatggtgtatatgtacacattttctttattcggtctatcattgataggcatttgggttgtttccaagtctttgctattgtaaatagtggtgcaataaacatacgtgtgcatgtctctttatagtagaatgatttgtaatcctttgggtatatacccagtaatgggattgctgggtgaaatcgtatttctgcttctagatccttgagcaattgccacaatgtcttccacaatggttgaactaatttgcactgccatcaacagtgtaaaagtgttcctatttctccaaatcctctccagcatctgttgtttcttgactttttaatgattgtcattctaattggcatgagaaggtatcttattgtggatttaatttgtatttctctaatgaccagtgatgatgagctttttttcatatgtttgttggccatgtaaatgtcttcttttgagaagtgtctgtttatagcctttgtgatggtgttgtttgtttttgtcttgtaaatttgtttaagttccttgtagactctagatattagaccgttgtcagagggatagattgcaaaaatgtttgccgattctgtaggttgcctgttccctctgatgatagtttattttgctgtgcagaagctctttagtttaattagatctcatttgtcaattttggcttttgctgcaattgcttttggtgttttagtcatgaagtctttgcccatgcctatgtcttgaatggtattgcctaggttttcttctagtgttcttatggttttgggttttacatttaagtctttaatccatcttgagttaatttttatataaggtgtaagaaaggggaccagtttttgttttctgcatatggatagcaagttttcccagtaccatttattaaatagggaatccttttcccattgcttgtttttgtcaggtttgtcaaagatcagatggttgtagatgtatggtgtatggtgttatttctgaagcctctgttctgttccattggtctatatatctgtcttggtaccagtaccatgctgttttggttactgtagctttgtagtatagtttgaagtcaggtagagtgatgcctccagtttttttttttttttttttgcttagggttgttttggctatacaagctcttttttgttccatataaaatgcaaagtagttttttctagttctgagaagaaagtcaatggtagcttgatttgaatagcattgaatctataaattactctaagcactgtggccattttcatgatattgattcttcctagccgtgagtatggaatgctttttcatttgtttgtgtcctctcttatttccttgagcagtggtttgtagttctccttgaagaaatccttcatgactgtttttaggagtattcctaggtattttattctctttgtagtgcttgtgaatgggagttcactcatgatttgactgtcagtttgtctattatcagtgtataagaatgcttgtgatttttgcccattgattttgtattcagagactttgctgaagttgcttatcagcttaaggagtttttgggctgagatgatggggttttccaaatatagaatcatgtcatctgcaaacagagacaacttgacgtcctctttttctatttcaatacactttatttctttctcttgcctgattgccctgggcagaacttccaatactatgttgaaaaggagtagtgagagagggcatccttgtcttgtgccagttttcaaagggagtgcttccagctttttcccattcagtatgatatgggctatggatttgtcataagttgcttttattattttgacatatgttccatcaatacctagtgaattgaaagtttttagcatgaaggcatgttgaattttatcaaaggccttttctgcatctattgagataatcatgtggtatttgtaattcgttctgtttatgtgatggattatgttcattgagttctgtatgttgaaccagccttgcatcctggggatgaagctggcctgattgtggtggataagctttttgatgtgtggttagattcagtttgccagtattttattgaatatttttgcatcgatgtccatcagggatattggcctgaaattttcttttttgttgtgtctctgccagtctttggtatcagcatgatgctggcctcataaagtgagttagggagaattccctctctttctgttgtttggaatagtttcacaaggaatggtaccagctcctctttgtacctctggtagaatttggctgcaaatctgtctggtcctgggcttgttttagttggtaggctattaattactgcctcaatttcagaacttgttattgttctattcagggatttgacttcttcctggtttagactggtgaggctgtatgtatccaggaatttatccacttctaggttttctagtttatttgtgttgagatgtttttatagtattttctgatggtagtttgtatttctgtgagatcagtggtgatatcctatttaacttttttcattgagtctatttgattattctctcttttcctttttattagcttggctagtggtctattttgttaaccttttctaaaaaccagctcctgcattcattgactttttttgaagggtgttttatgtctccatctctttcagttcagctctgatcttagttatttcttgtcttctgctagcttttgaatgtgtttgctcttgcttctccagttcttttaattgggatattagggtgtcaattttggatctttcctgctttctcttgtgggcatttagtgctataaatttccctctaaacactgctttagctgtgtctcagagatcctagtatgttgtctctttgttctcattggtttcaacaaactttgttatttctgccttaattttgttatttaacccagtagtcattcaggagcaggttattcagtttccatgtagttgaatggttttgagtgaatttcttaatcctgagttctaattgtattgcactgtggtctgagagactgtttgttatgatttccgttcttttgcgtttgctgaggagtgttttactcccagttatgtggttgattttagagtaagtgctatgtgctgtgagaagaatgtatatctgttgatttgggttggagagttctgtagatgtctattaggtctacttggtctagagatgagttcaaatcctgaataggcttgttaaatttctgtctcattgatctgtctaatactgatagtggaaagttaaagtctcccactattattatgtgggacctaagtctctttataggtctctaagaacttcttttatgaatctgggtgctcctgtattgggtgcatatatattagaatagttagctcttcttgtttcattggtccgtttaccattatgtagtggccttctttgtctcttttgatctttgttgttttaaagtctgttttatcagagactaggattgcaacccctgctgctttttgctttccatttgcttggcaaattttcctccatccctttatttgttttgagcctacgtgtgtctttgcatgtgacatgggtctccttaatataggacactgatggatcctgactctttatccaattttcccatctgtgtcttttaattggggcatttagcccatttacatttaaggttaatattgttatgtgtgaatttgatcctgtcatcatgatgctagctgtttatttttcacattagtttatgcagtttcttcatagagtcattagtctttatattttggtgtgtttttgcagtggctggtactgatttttcctttccatatttaagtcttccttcaggagctctggtaaggcaggcctggtggtgacaaaatcctcagcatttgcttgtctgtaaagattttatttctccttcacttatgaagcttagtttggctggatatgaaattccaggttaaaaattcttttctttaagaatgttgaatattggcccccactctcttctggtttgtagggtttctgccgagagatccactgttagtctgatgggcttccctttgtagataacctgtccgttctctctggctgccctacacattttttccttagtttcaaccttggagaatctgatgattatgtgtcttggggttcctcttctcgaggagtatgttagcgttgttttctatatttcctggatttgaatgttggcctgtcttgctaggttggggaagttctcctggataatatcctgaagagtgttttccaacttggttccattttccccatcacttttgggtaaaccaatcactgcttatttcattaagttgaccttcagtctctgatatcctttcttctgcttcatcaattcagctattgatacttctgtatgcttcacgaagttcttgtgctgtgtttttttttttttttttatatctccatcaggtcattaatgttcttctctaaactggttattctagttagcagctcctgtaaccttttatcaaggttcttagcttccatgcattgggttagaatatgagttcccctctagctgagaggagtttgttattatccatcttctgaagcctacttctgttaactcagcaaactccttctccatccagttttgtgcccttgctggagaggagttgcaatcatttggaggagaagaggcattctggtttttggatttttttttttttttttttgcatttttacgctagttttccttatcttcctagatgtatctacttttgatctttgaggctgatgaccattggatggggttttagtgtgggggtcttttatgttgatgttgatgttattactttctgtttgctagtttttcttccaacagtcagctccctcttctgcaggtctcctgcagtttggtggaggtccactccagaccctgtttgcctgggtatcaccagcagaggctgtggaacagcaaagattgctgcctgctccttcctatggaagccttgccccagaggggcactggcctgatgccagctggagctctcctgtatgaggtatctgtcaacccttgctgggagttctctcccagtcaagaggcatggggttcagggacccacttgaggaggcagtctgtcccttagcagagctcgaggactctgctgggagaatcctccttgtcaggatccactcttctgttcaaagctggcaggcaagaaggtttaaatccactgaagctttgcccacagttgctccttcccccaggtgctctgtcccagggagatgggagttttatctataagtccctgactggtgctgctgcctttctttcagagatgccctgccgagtggggaggaatttagaggcgtagtctggccacagctgctttgctgcgctgtggtgaattctgtccagtacaaatttcctggcctgcttagcactgtcaggggaaaactgcttactgaaacctcagtaatggcccctccccccagtaagctcggttgtcccaggttgacttcagattgctgtgctggcagcgaaaatttcaatctagtggttcctagcttgctgggcttcatgggagtgggacccactaagcgagaccacttggctccctggcttcagtcccctttgtaggggagtgaatggttctgtctcacttgggctccaggcacaaaacaaacaaacaaaacaacaacaacagcaacaaaaaactcctgtagctagcttggtgtctgcccaaacagctccccagtttggcgcttgcaacccagtgctctggcgatgtcagcacagaagggagtatcctgctccgtggattgcaaaaaccatggggaaagcataatatctgggctggatagcatagtccctcatggcttcccttggctgtgggaggaagatccctggcaatgcagaaacaccctgccttctgcattggtctcactgagagctgcagacaggagctgttcctattcaaccatcttgccagatctccatcttctcaaagttttactgtttctagtcttatgttgccatctttcatccattttgagttgatttttgtatatgataaaaaataagggttcacttttttcttttggttgtggacatccaattttctcagcaccattttttgaagaaactcatctttcttcattgagtatatttgggactcttattgaagatcagttagctgtatatattcatggatttatttctaggctttctagtttgttatgtagatctgtatctgttaatgtggtataatatacgtgttaatttttgtatgtgaaactatctttcattctaggaataaacttgccatgtcttctaggaaagaagtgatgctgagtctgaatacacagtaaaagccaagcaacactactggtcttgcaatctcaaaaggaagagtgagactttttacataatttaattattgaagatttcattggcaaaattaaaaacaaaaattctgctcaaaatgaagccaaaatattctgagtatttgcaaaacaatgttgatactatgagtggagttgttaatgttttgtgttcaaatacaatgtgtgaaacataaggaagctcagtaacttttgtgtggggtaacttttggattagaataataaatttcaatataagcccataaggttttatattattatttttcatagcttaaaaatcattgacatagaataattccaactaaagtacatattaaattcctggaaaataaattttgacttaacagggtaagttgtgaaaagacgttttgtcgcaggaaaaaggaaatcctccatttaaaaccctccatgctggaataaaggaggagtcccatcttttggtcattccacttcaggcttttgatataactaatcccttttcttcttctttcctgttttggcaagctttcggaaacaaaacaggcaacattttgtgatcataaatatcatagttgccacgcaggccagcaggaatgctatcacatccaaagagtggtactggatccaggtgaggttgtgggctgcgacccgaaggtgcttggctcctttatggcgcatgacaaactcaatccagaagactgctcgatccaggggcttcaccggttgatcatgatgaattcttgataatttcatgatattctctttatagctgaaggataaatataaagatatcaacattaaaagtaaatttattgcttaagcatatcaagtctatggatggtctttgaaaagcgccacacaagtgattcaaagtaagtgtcattgaattgacataaaatattaatgttttaatgtatgtcattacagaaagtttggtttttaaattggagttttatcactgacaaatacctttaaaaatgaaaaatggaattttcggtgggaaagttaatgtttttctagagcagaaaatattgtgagccattctaagtgctataagtaagatagtggaaatagaatctgggaatgatcattttgatatttttagttttttttttttttgagacaggcttttgctccattacacaggctgagtgcagtcacatgatcatggctcagtgcagcctttccgtttcggtctcaggtaatcctccacctcagcctcatgagaagctggggctacagctgcgcaccaccatgcctggctatattttttattttttacatttttagatatgaggtcttgctgtagtgcccatactcatctggaactcctgtggtctaatcattctgcctctgtctcccaaagtgttggccctacagacatgaaccactgtgcccagcccattttgacatatttaaagaagaattgtgtcacaactggtgaaatgtctcctaactagtttctcagcttctactctaatcttctgtcttctaccgtattttcctactagtagccagaacattttctaaattaatgtcaaattatgacagttgcctgtcaagatttccatctggtttcttgttacattaagaataaaatccaaatctgtctgtggtctagagaacgctacacagacacctacttgtcctaaccctttccccctgtacactttcttctagagacaatggccttctgttgttctttaaactcctgaaggtgttctcaccttagcccgtttacaccttttgttccccgtgtctctctcattgagcattctttcttgcaactacttgaggtttgcttctatttctttttgaggcttccccttaaatgatacctcttagagagtgttttcctggccacactataggcacccataggatttctctactgcttcgttcttattttgctatttgatttctggaactttaaaatatgttatatatcttccacaataaaagtttaagtatgaaatacataggataaatgtatatacgctatgtgactatctcaaaattttaagattatcttaaacattatccaaaagtgaaaacaccaatttatcacaaactgcatagaagaactctttcctcctgggccattttagtcactacttttatcctcaaagtaagtattaacctgaattctaatatcatagattatgtttatataattgaattaaataatacttattcatttctgtttttgtttagcagttgtttaattgcactggtgtagagtattcagttgattgacaaagaccacagatctcttcatttatgattaatggatatttgtgttgttaacattttttgatcttactaataattatggtattaagatatttatatattttattagatttacatacttattcatttttgttggatgtatacttggaagaatagttgatgagagaaaggcatatttataattagaattttttgactgaattttttaaaaaatattttttattttaaagaatcagagattgtttttagttatcattttctggatgatttataatttgattctagtatgactagaacatactatttttatgaatttgaatcttatacaatttacttagcatttttttatggcccagcatatggtcaattccagtaactatttcatacatataatctttttttttttttttttttgagacagagtctctctctgtcacccaggcttgagtatgacggagcgatcttggctgactgcaacttacgtctcctgggttcaagtgattctcatgcctcaacctcccaagtgtctgggactacaggtgctcatcccccacatctggctaagttttgtattactagtggacacaggatttcaccatgttggccaggctggtctcgaactcctgaccaaatgtgatcctcccaccttggcctcccaaagtgttggaattacaggtgtgagccaccacacccagtctccataaactcttttaaaaatgtttattttctgtctacacacacacaaccagagatatatgtatggatacatatatacagatatatgtgcaatatatatacacacacacacatataacacataggttacatttaattgtgtacttcaaatgttttatctccttaaataaaagttttcaaagatcattattttgtctactttggtctgtttaaatttaatgcgagtactggtaggttcacttttttgttgtgatctttgagatggagtctcgctctgtcaccaggctggagtgcagtggcactatctcagctcactgaaacctccgtctcccaggttcaagtgattctcctgcctcaaactcctgaggagctgggactacaggtgcacaccaccatgcctagctaatttttgtatttttagtagagacagggtttcactatgttggccaggagtatggtctcgatctcttgacctcgtgatctgccctcctcagccacccaaagtgctgggattacaggcttgagccaccacatctggtcggttcacattttttaaaaacagttttattttaagttccaggatacatacgcagaatgtgtgggtttgttacataggtatatgtgtgccatggtggtttgcagcacctatcaatctgtcatctagattttaagtccctcatgtattagctatttgtcctgatactctcactcccattccatgccccgaatggccccggtgtgttttgctcccctccctgagtccatgtattctcatttttcgactccctcttatgagtgagaacatgtggtgtttggttttctgttcctgtgttagtttgctgaggataatggctttgagtttcatccatgtccctgcaacagacataatctcattcctttttatggcacatagtatgccgccatactgtacatgcatcatattttctttatccagtctatcattgatgagtatttgtgttggttccatatctttgatattgtagatagtgctgcaatagacatacatgtgcatgtgtctttacagtagaatgatttatatgcctttgggtatatatcaagtaatgagattgctaggtcaaatggtgtttctggttctagatctttgaggaatcaccacattgttttccatgatggttgaactaacttacattcccaccaaaaatgtaaaagttttcctatatctccccagtttcaccagcatctgttgttttttgactttttaatcatctccattctgactggcatgagattgtatctcattgtggttttgatttgcatttctctaatgatcagtgatattgagcttttctcataagtgtgttggctgcataaatgtatttttttgagaagtgtctgtttatatcctttgcccactttttggtggtggtgttttttttcttgtaaatttgtttaagttacttgtagattctggatattggacctttgtcagagggatagattgcaaaaatgttccctcattctgtaggttgcctgtgccctctgatgatggtttattttgctgtgcagaagctctttagtttaatttgatcccatttgtcaactttggcttttattgtaattgcttttggtgtttgtgtcatgaaatttttgcccacgcctatgtcctgaatgatgttgcttaggttttcttccagggtttttatggttttgggttttacatttaagtctttaatccatcttgagttaatttttgtataaggtgtaaggcaggggtatagtttctgttttttgcatatggccagccagtttccccagcaccatttattaaatagggaatcctttcccattgcttgtttttgtcagttttgtcgaagatcagatggctgtagatgtgtggtgttatttctgaggcctctgttctgttccattggtctatatgtctgcttttgttccagtactatgctggtttggttactgtaaggtgtaaggaagggatccagttgcagttttctccatatggctaaccagtttttccaaaacaccatttattaaatagggaatccttcccctaattgcttgtttttgtcaggtttgtcaaagatcagatggttgtagatgtgtaatgttatttctgaggcgtatgttctgttccattggtcaatacatctttttggtaccagtaccattctgttttggttatgtagcctaatagtatagtttgacatcaggtagcgtgatgcctccagctttgttctttttgcttagggttgtcttggctatatgggctcttttttggttccatattaaatttaaagtagtttttttctagctctgtgaggaatgtcaatggtagtttgatgggaatagctttgaatatataaattactgtgggaagaagccaagatggccgaataagaacagctccagtctacagctcccagtgtgaatgacacagatgaggaatgatttctgcatttccaactgaggtactgggttcatctcccaggggactgtcagacagtgggtgcaggacagtgggtgcagcgcaccacgtgtgagccaaagcatggcgaggcattgcctcatcagggaagcacaaggggtctgtgaattcccttccctagccaaggataggggtaacagatggcacctggaaaattgggttactcccaccctaatactgcgcttttccaaaaggttttagcaaacggcacaccaggagattatatcgcgcacctggctcagagggtcctacgcccacggagcctcgctcattgctagcacagcagtctgagatcgaactgcaaggcagcagtgagactgggggaggggcgcctgccattcccatggattgaataggtaaacaaagcggcccagaagcttgaactgggtggagcccaccgcagctcaaggacgcctgcctgcctctgtagatccacctctgggggcagggcataaccaaacaaaaggcagcagaaacctctgcagtcttaaatgtccctgtctgacagctttgaaaagagtagtggttctcccagcacgcagcttgagatctgagaatggacagactgctactcaagtgggtcctgatccccgagtagcctgactgggaggcaccccccagtaggggcagactgacacctcacacagccgggtactcctctgagaaaacttccagaggaacaatcagacagcaacatttgctgttcactaatatccactgttctgcagtgtccgctgctgatacccaggcaaacaggatctgcagtggacctccagcaaactcgaacagacctgcagctgagggtcctgactgttagaaggaaaactaacaaacggaaaggacatccacaccaaaacccatttctacatcgccatcatcaaaaaccaaaggtagataaaaccacaaagatgggggaaaaaagagcagaaaaactggaaattataaaatcagaatgcctctcctcctccaaagaaatgcagctcctcaccagcaatggaacaaagctggatggagaatgactttgacgagttcagagaagaaggcttcagacgatcaaactactccggactaaaggaggaagttcgaaccgaaggcaaagaaggtaaaaaccttgaaaaaagattagatgaatggctaactagataaccaatgcagagaagtccttaaaggacctgatggagctgaaaaccatggcacgagaactatgtgatgaatgcacaagcctcagtagctgatttgatcaactggaagaaacggtatcagtgatggaagatgaaatgaatgaaatgaagcaagaagagaagtttagacaaaaaagaataaaaagaaatgaacaaagcctccaagaaatatgggactatgtgaaaagaccaaatctacatctgattggtgtacctgaaagtgacggggagaatggaaacaagttggaaaacactctgcaggttatcatccaggagagcttccccaatctagcaaggcaggctgacattcaaattcaagacatacagagaatgccataaagatactcctcaagaagagcaactccaagacacataattgttagattcaccaaagttgaaatgaaggaaaaaatgttaagtgcagcaagagagaaaggtcaggttacccacaaagggaagcccatcagactaacagctgatctcttggcagaaactctacaagccagaagagagtgggggccaatattcaacattcttaaagaaaagaatcttcaacccagaatttcatatccagccaaactaagcttcataagtgaaggagaaataaaataaaatctctaagcatttacagacaagcaaatgctgagagattttgtcaccaccaggcctgccctaaaagagctcctgaaggaagcactaaacatggaaaggaacaactggtaccagccactgcaaaaacatgccaaatgataaagaccactgaggctaggaaaaaacggcatcaactatcgagcaaaacaatcagctaacatcataatgacaggatcaaatttacacataacaatattaaccttaaatgtaaatgggttaaatgctagaattaaaagacacagactggcaaactggatcaagagtcaagacccatcactgtgctgtattcaggaaacccatctcatgtgcagagacacacataggctcaaaataaagggatggaggaagatctaccaagcaaatggaaagcaaaaaaaggcagggattacaatcctagtctctgataaaacagactttaaaccagcaaagatcaaaagagacaaggccattacataatggtaaagggatcaattcaacaagaagagctaactatcctaaatatacatgcacccagattcataaagcaagtccttagatacctacaaagagacttagactcccacacaataataatgggacactttaacaaaccaccgtcaacattagacagatcaacgagaaaaagttaacaaggatatccaagaattgaactcagctctgcacgaagaggacctaatagacatctacagaactctgcaccccaaatcaacagaatgtacattcttttcagcaccacaccacaccaactccaaaactgaccacatagttggaagtaaagcactcctcagcaaatgtaaaagaacagaaattataacaaactatctctcagaccacagtgcaatcaaactagaactcaggattaagaaactcactcaaaactgttcaactacatggaaactgaacaacctgcttctgaatgactactgggtacataatgaaatgaaggcagaattaaagatgttctttgaaaccaacgagaacaaagacacaacataccagaatctctgggacgcattcaaagcagtgtgtagatggaaatttatagcactaaatgcccacaagagaaagcaggaaacatctaaaattgacaccctaacgtcacaattaaaagaactagagaagcaagagcaaacacattcaaaagctagcagaaggcaagaaataactaaaatcagagcagaactgaaggaaatagagacacaaaaaactcttcaaaaaatcaatgaatccaagagctggttttttgaaaaggccaacaaaattgatagactgctagcaagactaataaagaagaaaagagagacgaatcaaatagatggaataaaaatgattaagggggtatcaccaccgattccagagaaatacaaactaccatcagagaatactataaacacctctacgcaaataaactagaaaatcaagaagaaatggataaattcctcgacacacacaccctcccaagactaaaccaggaagaagttgaatctctgaatagactaataacaggctctgaaattgaggcaataattaatagcttaccaaccaaaaaaagtccaggaccagatggattcacagctgaattctaccagaggtacaaggaggagctggtacccttccttctgaaactattccaatcaacagaaaaagagggaatcctccctaactcattttatgaggccaacatcatcctgataccaaagcctggcagggacacaagaaaaaaaagagaattgtagaccaatatccctgatgaacatcgatgcaaaaatcctcaataaaatactggcaaactgaatccagcagcacatcaaaaagcttatccaccttgaccaagtgggcttcatccctgggatgcaaggctagttcaacgtacacaaatcaatgaatgtaatccagcacataaacagaaccaatgacaaaaaccacatgattatctcaatagatgcagaaaagacctttgacaaaattcaacaacacttcatgctaaaaactctcaataaattaggtattgatggggagtatctccaaataataagagttatctatgacaaacccacagcaaatatcatgttgaatgggcaaaaggtggaagcattccctttgaagactggtacaagacagggatgccctctctcaccactcctattcaacacagtgttggatgttctggccaggagaataaggcaggataaggaaatacagggtattcaattaggaaaagaggaagtcaaattgtccctgtttgcagaagacatgattgtatatctagaaaacctgatcgtctgagccccaaatctccttaagctgataagcaacttcagcaaagtctcaggataaaaaatcaatgtgcaaaaatcacaagcattcttatacacccataacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggaaacaaaccaatggaagaacgttccatgctcatgggtaggaagaatcaatatcgtgaaaacggccatactgcccaaggtaatttatagatccaatgccatccccatcaagctaccaatgactttcttcacagaattggaaaaaactacttgaattcatatggaaccaaaaaagagcccgcatcaccaagtcaatcctaagccaaaagaacaaagctggaggcatcacactacctgacttcaaactatactacaaggctacagtaaccaaaacagcatggtactggtaccaaaacagagatatagaccaatggaacagaacagagccctcagaaataatgccacacatctacaactatctgatctttgacaaaccttacaaaaacaagaaatggggaaaggattccctatttaataaatggtgctaggaaaactggctagccatatgtagaaagctgaaactggataccttccttacaccttatacaaaaattaattgaagatggattaaagacttacatgttagacctaaaaccataaaaactctagaagaaaacctaggcaataccattcaggacataggcatgggcaaggacttcatgactaaaacaccaaaagcaatggcaacaaaagccaaaattgacaaatgggatctcattaaactaaagagcttctgcacagcaaaggaaactaccatcagattgaacaggcaacctacagaatgggagaacatttttgcaatctactcatctgacaaagggctaatatccagaatctacaatgaactcaaacaaatttacaagaaaaaaacaaacaacctcatcagcttgtgggtgaaggaaatgaacagacacttctcaaaagaagacatttaggcagccaaaagacatatgaaaaaatgctcatcatcgctggccatcagagaaatgcaaatcaaaaccacaatgagataccatctcaccccagttagaatggcaatcattaaaaagtcaggaaaccacaggtgctggagaggatatggagaaataggaacacttttacactgttggtgggactgtaaactagttcaaccattgtggaagtcagtgtggcgattcctcagggatctagaactagaaatatcatttatctagcattcccattactgggtatatacccaaagggttataaatcatgcttctataaagacatgtgcacaagtatgtttatggaggcactattcacaatagcaaagacttggaaccaacccaaatgtccaacaatgatagactggattaagaaaatgtggcacacatacactatagaatactatgcagccataaaaaatgatgagttcatgtcctttgcagggacatggatgaagctggaaaccatcattcccagcaaactatcgcaaggacaaaaaaccaaacaccgcatgttctcactcataggtgggaattgaacaatgagaacacgaggacacaggaaggggaatatcacacaccggggcctgcttgggggtagcgggagtggggagggatagcattaggagatacacttaatgttaaatgacgagttaatgggtgcagcacaccaacatggcacatgtatacatatgtagcaaagctgcaccttgtgcacagataccctaaaacttaaagtataataaaaaaaattactttgggcagcatggccatttttacaattctgatttttttatccatgaggatggaatgtttttccatttgtttgtgtcctctcttaattccttcagcagggttttctatttctccttgaagaggtccttcacgtaccttgttaggcatattcctaggtattttattctctttgttgcaattgcaaatgggaatttattcgtgatttggctctgcttgtgtattgttggtgtataggaatacttgtaatttttgcatattgatttttctatccggaggctttgctgaagttgcttatcagcttaaggaattttagaactgagatgaaggggttttctaaatatagaattatgtcatctgcaaatagagacaatttaacttcttctctttctatttatagaataccctttatttctttttcttgcctgattgccctagttcacatttaaatccaccattttattctatatatttttgttttctaacctgttttctgtttctttgcttttttactttatttgaagtattttaaatcatttcttgtcttactaattttttggtaaagtgtttttaatgtattctcttagctggtaccaccttacatcataataatattggtaggattaatagactctgaattgatggtagctggtgtagtcacagcattttccatattatttcccttggattatggaaaactattacatatttattttatcaatattaaaaccttcatgtttcaaaaggcatcctccaaaaagtaaaaaaaaaaaaaaatctatctgcccatagtggaagaaaatatatgaaaatcgtatatttgataagggatagtatctataacatattaataattcttatgaatccataataaggtaaatagaaaaatgacaaaatgttcacaagattaaaatagaaattttatctaaggaagatgcatgaatgatcagtaagcacatgaaaagagggttaacatcttcagccataaggaaatgcaaatgaaaaccataatgagagaccactttacacacactagaaaggctgtaatagaaagacaggtgataacaagtgttgggaagagtgtgaagaaattagagccctcctatccagctggtggtaatgaaaaatgatgcaaatactttgaaaaacagtttagccattcttcataaacaacaatttcccatatgcctcagcaagtccactcctagcctctcctcaaaagaagtaaaaacatatttttacacagaaaatatgtataacaatattcgtaagtgccaaaattggaaagacctaaaatgtccatgccctgataaatgggtaattttggtataaacatatcaaagaatattatatagaaataaaaatgaatgagttctgatacatccaacaacataaataaaactaaaaataattatgctaagtgaaagaagtcgtttacaaaacactataaattgtatgatttcatttatataaaatatgtgaagagaataatctattgagaaacaaagtaagtcggtatttttctaggactggaggtgtattgggagtgacttcatgcattttgagtttaatttgagctcacaaaaatgttatttagggttgtggcttcgtaactatgtaaacatactaaatatatttagattttaaattttagtgaatgttatgctatgcaaattgtaactcattttcaaattgattaaaataatgataataataaaaataaatttttgagaaagaatagattcatactttcagaaattttaggtattgaattgaaatattttatcatatttctctagttacataatttctattgtgtattctatcattaaaaatatttaaaataattatgtacatatctttaatttttttgattttataattcattgcagtcattggtgacccattaaatctgtggggttgaaatgtaactttgaaataattgtctggtggaaaataagagcagattttacattggttaaatcacttcaatcccttcaaaattagtctcttaacaaagggttcaaactcatattcactgttgacaaaataatttgtaagtaccacctggtcacaaaattgtaatactcacatagggtcattaatgactgacttcaatgcattgagcaaatctctacttgacatggtcctgatgtccacactgagggctgctcccttggctttcatgtgagcaatgttatcatgttgatccgcaaacaagggaatgcccaccatagggatcccatggtagattgcctcatagatgccattggttccaccatgagttataaaagctttggttttgggatgacctaaaagtggatgcattttaacaaagttattaattataaggcacaggaattgaataagaaatgcacaatataaggaacttaaagcaaaactgttccctaggtaacattatacccacaaaactgcattgaaattgttttcaaatttcagaggaagaagcacctacttctgctggaaaggtaagtgaaggctacatgaaaaggtggtggtctgtgtgtcttcacagtggaaacataaatttaaaagtttgccaggtgaacaaaatgaaaaaacatattcttaattaaaaaattaaaatgtgcaaaaaagaaaagaataagatttggtatacaagaacatagtctcttaagtagtataaattatgcagtcacatttatatatttaaaaaatatttaaatagttaaaatatttaaaatacttaaatttttttttaaaggcagcaaggagtagggtggaggtggtgctgaggaaggacaggttacacatcatcatgaaatgtgttatcactttatgataaagattggtgatttattcccacagaaaatagagtcactggtaatagaagaatgtctgttatttttcagtacctgttgaaataaccctgcagtaggggaaggaacagatgtaaagttgcagaaataagagacagaaaatccaggatgttatttaaaacctgtgagaggtaattacacctgaataaagagatttttattctgaccataaagaatgtgactgtatgtaacaaaatgccaactaccatagtgtattcttcttatactaagactagaaaataaatataaagtagttaaatttgatttttttttagttttccaataataaatgttaaatatgtttgttttatgttgaaatattatcacttctaattggctgttactaatatattcagtatttgttctccagagtcttaccaagaaggtcattctggggtaaccacttatacagtcgagtattggaacctaaagtatttggcttcttgccatcaaatctccatagaacctgttagggcaaggaaaatatcttgttcaatgaatagaactctaaaaatataacttgttagaattctgaagagattaataatcagttaatccatataaaagatgaagaaataagaagaagtgatgtcaagtaatgagaactactaaaagtctgaggtaagctgaatacccacatttaatatctttacttttataatcaatttggtatataaaaaaatgacatttctaacttaatagctagacacatgagagtgtgagaggaaaataaatcttggtgccccaaaatctatgctaaagggaaaagttaagctgctcagggcaaacctacttcccattctattcaaagtcagcccttggctcactgagataaatgcatatctaattgcctcatttggagaggctaatcagaaactcaaaggaattcagccatttgtctcctatctacctatgacctggaagccccttccatgcttcaagttgctctgcctttgtttctagttgtcccccatttctggactgaacaaatgtccatcttatataagttgattgatgtctcatgtatccctaaaatgtataaaaccaaactgtccccccaccaccttgggacacatgtcaccaggaccccctgaggctgtgtcatgggtgcacattttcaaccttggcaaaataaactttctaaattaactgagacctgcctcagatattcagggttcacattttggtaaccatgaagagactctgagtggaggttccctgacctttgataaatgtcctgtcagtgcttggtaccagcatgagctaactttatggctcaaacaaataagacaattggctgaggtctgggagcaacccctccagagaatccctgataccccaaaattcagtcaagaccaaaagtttattttgctgtacaactcctttttttttgttttttatttttttttggagttttacttgcttcctacaagaaaggcaatatttcctgtttccatgacaatggaaggcaggtaactctatggagtttgagctcactcccaggagggaggataaatttgaggtttctttcctacttctaggacgacagagggcagttttagcctgaaacccatccgtaggtaaatagctgaattggggttttgtcttggttaatgtttaacaactagctggacttaatttctccttaccattacagtgcttaatgatcacatttttgggagtattttttttgtacattccagtatttctcccatcagatttgacaaactttacctgacttgatcatatctgagtgagaattccaaattgtgggtaacaaagcctgtctaatttggtgaaaattcttcacagatgcaaaagagaaaacaaaacaaaacctaaaaaccatgctcttggtttctgtgtttgcttcctgtctttaaaaaaacaaatgttcttttgtttacttttcctccaccctatacctccttttgtcttttgccatttgtagtaccaaaaatctagagaaggcttctaatgatttgaactcttttaaagaattcagaacaaaggcaccactcacccctttgggggtgctctgttttctttgtggagtttcaagagttgtgggcagattttttcttaggtccaaagctctgttttcctatgttgaatgacctgatctctttggcttcgagattaccacagattaccttgtactgtgagaggattttaccttggcgtgtgtaatggcagacgagttacaaagtagagggtggctgagtacagtttactggaagtagtattgactgttgttatttttttcctcctaggaagttgttgtttaagaatcctaattctagtttggagatgtgttgtaaagggtctcctctattgtttttattccccaaattaatctcatttggcttgtctgtgtggatttgtgtgagaaactgaactgtggtttacataggaaaatgaaagactgagttttctcagctccaaagtgaaagggcatctgctcctcccaggcaaaaggcacccctaagcaactgggggccttgtgggagtgtcttgggtttgaccccctatgacatgcagtggtcctgcagggaaatccccaagaaaaattaacttttaaaaaaaggctagtccaggaaacacatatgagggcagatcacccagcattttgagccctctcagaggtcatacacctctggagggagaaactgagacacgtaagagggtggaaacaactcagtggtgacacactgtggagtactgcccacaagcagcacacattgattcaccacacataaaccctaggccacagctcagttcctccttttaggaaaaaaagtgggaaacaaataatctaagaatgatgagaaaagaagaagaatgatcccctgatatcgcctgtttggatttatgacacctctacttggcagagtttatgtaaaatgaaggtaatacggtctttgtgcacatatacattaagagccctaaggttgtcctacaaactgtagagttcctaagttctctcttttttaaaaattttcttttattcttgctttaaatttgcttttatttttctattaagttaaaaaccactgttttgattcaacaggtttttgtctgcaagctggtgatttttttttatctcatagctaaatttctgaagtaaaaaccacataatcttttgtgtgtgtgtaagtgtttgcatatatttaaaaggccattataatttctataattttatgtttaattggcaattaaatccattttattttccttctagcacaccaatttttttctctgtgtacattatgatgtaaattttgctatttgattttcacctgaatggtttcttttaatatgcaaatgtaagattatttagctcacaactgcctatggtgatcaagtattcatacagattacctattgaaacaggttatcaagaatttgaaagtctaatatggcaaagaggagtttttataaacctgtaagatgtacttctgttggcatgcttactacatctatgtatttatgtgttttgtacacaatgttttattactgaaaatatataaaagagctctaattaattggcttaagaaaataaaagtgcttgaattaaatactttgccagaaaaaaagactaattaaatgctttttcaagtttatgtaacttaaataaaatcttttataaataagataacaacaattattgataaagtatgataatattagaaatgcattaagacttgccagcatacatttttgtttgcatttattaatcaagaaatttcatacttattcttgccaaatactttaaggtgtcaaaatttgacataggggttacaaaactgtaaaccaagcccaaaacagaatgatcttcacttgtgtaatttttaataaataagacattaatattggtttaatgcaaatagctacaccttgaattaagtaagattatcataacttctcatcttgtggccttaagcaatctagtccacaggcattaagctttgttttgggaaaagactgttatcatttttatttcaaagctaaactataaactaagttcctccttaagttagtttggcctacacccagaaataaacacggagagcttggaggttaaaagcaagatggagttaggtcagatctttttcactgtctcagttataattttgcaatggcaattccataactttaaatgatgactaccacacttttcacaaatattctaggtaaatgactaaataattaggtaaatgtaatgggataaatacttatagacaaactcataatttagaatctaaggttatattaaattaaataatagatatttcattgtttgggtatttttaaaaaaaaatttgtaggaaaacattctttccaaaaaaaagtgcatcttttttaaaaaggtgaagaagtgttgtctaattcaaagcttatttaaaggttatgtataaaacaaggtaaaaggaaccaggaagtaagggagatgtaaagaaagttataaaaataaaaagttttttttttttttttttgtaaaaagcttgaagagaaataattttatatgagaaagaatcttgtgtggtaaatttagtcctagaataaaatgatcagttgtgtaagaaagaaggatgttcaggacaaaccagaaagtccaaacatatcatgaatgatctgtgtaagtcacaataagaagattaaaaaaacttttatatgatcaagttgtctataattaaagggaaattataatggtgtttctacagattgggcttgatgtaaaaaaagcacttatgcactaaataattggttagaacaataacattttcttaagggattgatttactcttaaaatattatgagttttttttttttaacccaaagtttaacttttcttgcatctcactgtttttggttttctctccccttttaaagggtgtgaaatagtaacactctccttcaactcattttcaactcatgtaagttttttcctcaagttctgtttgttgtggcataatgctaacagtgttttctaaaagctattcaactcctcaaggtccagggactatcacagaagaggtgggtgtgtgagattgaaagaactgatactaagagataaaataagttccgtttatgcataaattaatcattaatgtcaaagacacactaatgcaagaccaacatatgggcccctgtgtcagattaacaaggttttcttgaagcataaactgacttcttaataaagattataaacgttatgaaaggctgaggaaagttatatcttatggtcaagattagaattttatagattgttcatacaattttgaaaaacaaacttatttggcttcatgctgttttattagggcttattgtttggcaaattgagtctcctctctcaaagaatgaagatttttgcctttttttgaaatccttgagttactactttagtcaaatgaatgctttattttacctgtgatatcaagctttttaatcctttgatatttgacaaattttccaaaattatgtttttttctgacctaagtaatcctttaatttattagtttccctaaagtccaaaaatgacataatttggcttatttggtataaaaattatacagggaacattgtcaaacatgaaatggtgtttggtctttttgagctgtatttatataaatatgttattggcatgtgttccaaaattatgggaaactcctataattctgatatgacttagtgtgtacattatcagtaataattatatttgttatgttaagttattgtgtgccacagaggtaacaaatttccttgtccattgtgtctttgactgaggctgccctaaaactttttgtcatccacagacaattgttgtctgactttggtcctctttagaaggcgattttatactcagccatgaaattctaacaggtgctcttgaaaaaaagtttttgataattttggagattgtgacattagaatggaagaaaaactttcaggactcatggagaactaaaatgttcatgaatatcaagcagaacaggaattaactacatggactgaaataatagaaaactaaagtaatctttttgactttgcttaaaacattgctgatcctttgttttgttttgtttttttttttagagtgaaggaatctttctttttttgagctattaacagcttttaacaatttagtatactcctatgaaaaaaatttagaacatatttgtttccctctacctgatttttcagaatttggaaactatttgtgagtattttttacttttgtcaatacagttatttgcataagtgcaataagaatctattttcatttttaacaaaacacaattggagaaactggttattttatcaaggcttccactggaatggtgggctttcctttagggaatcaaacttaacttatggagccaataaaaccccttgggaaaactggcctcataccttcatctataaggtccctgtacagggttcctgaactgtgttaagcaaagaatgtaactttctgacaggcccaggagccccaagtttattttggaaccccaagaggagaggaattcacccaactcataggtatttgatggtacaaatctatggcttgcctcagctttaaaaaagtcctatctgagattctttctataagacaaagttccatcaaagccactttaaaagcctatgtaaataaaaaattattcttcctcctctgtatacaataatcaggccaagtataataaagcaaatcagttgtaccatggtttgtctttagtaaaattgggaaactgaagacagaaaaattatgtttcaaaaataacagtatacctgttgttagattctagtcttgcctaatgtttttcaatttttattactgtctacagtttggactgaattctaatttttcatggctacacgtcttcaaaatagtgtcttcaggttttttttcctccccttccacaatttttcctaatttggagtcactgtaaactaagctatgctttcataaagccctacaaattaagctagacaacttaaactccagaagaaaataacagcaaccaatttacatacataatccactttcatacctgcctactgatttatggacttcagagtaatgtggcctatattaattttaaaggattgttcttttgtttttgtttttctcacttcctccctttattttgtcttcacagtacatgagacttcagaacctgctaaaaatgaactttcctaataactcaggacctgcttaggaataaaccttccttgccattagagatcagatgaaaacctgagaccagagactcattttcttctaaaatgctttctccaaaagatttttttaaaatgtaaaatgaaaataaacctgggggccccaaagtcactaagcaaatcactgcctcccattctattcaaagacacccctctgctcactgagataaatgcatatctgattgcctcctttggagagcctaatcagaagctcaaaggaatgcctcttccctgcttcaagttggcaaaataaactttctaaatgtactgagacctgtatcagatatttggggttcacaagattatcaatgaaatattcaaatatataagaattgttaggcagtcttaattctagtaataaaaaagtagcaaattagtaataacctatatatttattttatatactttatactagctgtaaccttccaaatttaatataaatttattaatttttgagtgatatgggaagagtttacttatatccacttgtctactagtcataagttattttatgaatttgacatcattgattacaaaagactaaatacttaaactgcacatatggtgagaaataatgctacatatgtagtaaattcagactattatcagtattgctacttttgtaaatgctaacaatgtaggaaaaaggagcccattgacaattcatgattaacaatacagatgctgagaatgtagaaaattgtattttgctactttttgcttaactgatctttcacacttagatgatgcactacctagcattgacagccttgatatatggtcagctatagccagtcattaccatgtctagtaccaaactaaggtactgattttagatttcccaagcaatctttataaactggagtagaatttacaagtgttgtccttgtatttgatatgggagtgttaaagtaactctgtgttttcagcaaaaacttgcatagatcattcagagagggctatgcagataagaaagtaaaacgtaaattgaaaatacacaaagattgtaggtatattctatagattagaaaataagttcctaccatgtttatttatagttcctgctccttcctcaatgtggagaaggcactaatctgattcttagagcatagtctttgttgggccacatttaataatgcacatagtctaccctaaaagcaggattctatctccatcctttccattacatttttctgcttaagacattagcggcacccaagccagcagagcagacaagtttttctttttctctaaatctacttggctaggtgggtacctccagagcagtggctagtcagactaggacattctttctctgaatggcaccctgaacagaacgctaaatagacctattccaatgcatgggaagtaaaaacagccagattgcttggtaagacgaagctgcatgatgcatttcaaagttttttcaatacctgcttattgttattgtgatagtacagtaacttattaaaattttaccgctttttgataatatctacagtgtatacagtaccttctaaaatcctgtaaaccaaaaggagcaaatgacagggcagaatttagtgatttctatgtacatgctacgataccatgataataccaaacttcactagcacctcttaaatatatttccttctgatcacaatattaatgccaacgttattatcaaccaaaactcctctctttatgattttaagatcttccatatatgtttttgctttgaacagatgtctgagataattagaactatcatagcagttaaattttcaggcagaacatttctgtaatggactcttgaagagtttaacagattcatttagtagccatccacagttaaggcactttatctaaccttttgtgggatctgggcaagggctgatgcaatcatgttggcactttcttctgacatgttactgatcatcgaccccagagaaaacaccacaataccattttctccagagctctgcacaaactcttccatttcctgtgaagaaagaatttgttctatcagaaaagagcaacagcacagaaaacactgttgacaggattgttacaaacatctaagatgagaaagtcaggagctattggagtaatttttttaaactgacctaatcattcagtttctttgaaaggagatgtgtaatataatatatgtgggatctttcatgcaaatttgtgtaaatatgtgtgcatatgcatgtatgtatgtgtgtgtaaggaagaaatgaaacaaagctatgacactgcagtaggaggagataatgctagaaaatattacacccagacactttatttataatattataattactaacataggttattggaaggtagctttacttggctttaattctatttttttttgtagttctactaaatctcttgtgtttatttggggtcattttattttatttttttctgttcagttcttttagttaggagtcattggagccattacatgactatgagcaatgaggaaaagttagttacaattagaatgattttatatctacatttatttagcttctttagctctctaaccctttatatttcacttagagtttcctagtcttaccccactacccctcacttcccccgacacccccacccccaaaaaacaccttaaaagctgaagtataagaatcattgacgttcatcagtctggtgttggggcttggaatttccgggaaatagttctgagaattccatttataatacagtattatatactatttagttacataattaagtgatcttatttctcagatcattgtttaggtatgactatgataccttttgtcctgaaatcacactgtgaaattgatgtgctatttataacttaccatgagggaccctcatcctcactttgctgtgtctcacagggggcacttgaaccacagtgggagaggtcaccaagcctttctccagtggagatctgctcaccccctagagtagctccctcacactatatgaagctcctggtaaatatgtgtttgcttcgaaatgaatgagaattattctgacttgtgtttcctgatgtgttcctgtttttaaacttaaatccattctctaatgccacatcagtcaatgtattctcacaccaaaaaaaaaaaaaaagaaaaagaaagagagaaagaggaaaagaaatgtagactcataagtttcccggatatcatatcaaaattgtatactcatctttttgttgctattgtcccttttgttctaaattctttttttctcagtaaaataatgaccaaccccttctatcataacaaatatactttctggtcctaatcattgggggaaatttctttataaaactgtttacgaataaaaaaggaaattctaaaatatgtcaattcagaccatatattggtatttttcaaaaatataattgaactttatgacatcttttatttttattttattttatttatttatttatttttgagatggagtcttgctctgtcacctaggctggagtgcaatgatgcaatcttggctcattgcgacctctgcctcccaggttcaagcaattctcctgcctcagcctcctgagtagctgggattacaggcacctgccaccacgcctggctaatttttctgtttttagtagagacaggtttcaccatcttggccagactggtcttgacctcctgacctcatgatccacctgcctcggcctcccaaagtggtgggattacaggcttgagccactgtgcccggtctgatatcagttttaattggagattcagtgtatggctattagagttaattcatgaggcatccaggaactcagtgtaattgcagttgcctgtagccacatttaatgtaacttcggtttaatgttttgtctcattcactgacaaaagtcttcttcatccaccaagtattgaagtaaaaaatcgtctgtttatagacagatcagcactgatctcattctgtgacgtctttatgaaagcaatggtaatagaagatcaatgtaagtagtcttgtaaaagtatgaaaatttaggaaaaaaatcatttttcccatatctctatctcaatttaaaatgtgtaccatttcattatggttttaattctatttatataactcaatgtacatatgtgatgtttatttagaaaattttttctcattgtatatgcctttttatcctacaaaaaaattgtgatcttgttctactcatcattctgttccttagtttccaactatacctgtactacagctgacagtgtaattaaacattgttttgaaaaaatggattgtaatggcttggtatgcgcattgtataagtttttaaccatttcttaatgtaagatatttgaattatttccagagttttttaacgaatatttgctactaatattgaatcttaccatcatgatttattctctgtacagtttcatgtgaatatattacaaaggcaataactatatgcagttttcaaacacttgatactttttggcaagagtcttattcttttgaaatatacaaacattatctgagaatctaatacataatggaaaagcaagcaaatttgtggcaacaattattttgtgtacaaaagaattagagaatcggtttcacaattatttacttagattcaagtctaccttttgcaggttaacaacaacagccagtgccgggcacggaggctcacacttgtaatcccagcactttggaaggttgaggcaagtggatcacctgaggtcaggagttcgagaccagcctggccaacatggcgaaactctgtctctactaaaaatacaaaaattatccggatgtgttggtgggtgcctgtaatcccagctacttgggagtctgaggcaggagaatcagaatcacttgaacctagagggtggaggttgcagtgagctgagatcatggtagtattagtaataatcactattgtactactagtcatttattccttgtcctccttattctcctattctcttccccctgctaatggcactatcactttcttttgatgtgagtgaggatttttttttgagaataagataagagtacacagaattaccttttaagctaaaatattaatgaagtgcctccacctttgcaatacaactttagctttccagcgtgttcaactgactgcccaaacttaaacatttatatttaaacaagcacacagagtatctgttctctaggattttgctaggaaaatcaatcattattaaatgaagactgatatcttaaatggctggcacatgttagctaatttaaaatattagaaataatgactaaaataataatcataatatcaacaatatttttggatcactggctatgtgtcagagacaacttaagtgttttatctgtggtaactacttttttccacacaacacaatatgaagttgtgattattattgtaaaagtagtcatgattgcctaaactcatgtaaaagttcctaaatattctttacattgtacaaagttgcctttctgtaatattacacattgagaacattgggattttttttgaaaggaaatctgatcatatctcttcatttcttaactcttttcagtagctctccattgtccttaatgggtatatcaaatttcatatatatatatatatatatattttttttttttgagacagagtctcactctgttgcccaggctgttgtgcaatagcatgatctcggctctctgcaacctctgcctcccgcgttcaagcgattctcctgcctcagcttcccgagtagctgctattagaggtgcctgccaacatgcctgactaatttttgtatttttagtagagacggggtttcaccatgctggccagtctggtctcaaactcctgacctcaggcgatccgcctgcctcggcctcccaaagtgctgggattacaggtgtaagccaccacgcccggcccatcattgacttttactcaaccttttcctgtaaactaaatttggagtcctgggaactgcccttactgcttttctacttttctgccttaatgcaagactttacttttttgtttgtttatttgtttgtttttgagacagagtctcactccgtcgcacaggctagagttcagtggtgtggtctcagctcactgcagcctctgcccccagactcaagcaagcctcctgcctcagcctcttaagtagctgggactatgagactacaggcacacaccagcatgcctggctattatttttatttttgttagagatgaggttttaccatgttgcccaggctggtctcaaactcctgagcccaagcaatcgtcccttctctgcctcccaaaattcagggattataggtgtgagccaccttgcctggcctctggttttctttttgggtctttctcatcccctcatcgtttcacctatctctgcacattattgagtactcactttaattgtcaatgagtttgggatctcttctgcatatttctttatcattgtggtctttccttataacactttttagacttttctttttcacttgtttttattctatctttcaaagtacaatgttaggcatgagggcgcagaaactgtgctacctttattctctgaaaatccagcacttacctgtggtttgcattaatcactctacaaatattttttgaagaaatgaaccatactatcttgtgggttgcacaatgaaggccttactttaaccaaccctgttttcaaaatctccctagtaaacctctttggtctttaatgataataacattcacatacttgtgatagtatagaaatatatgattttctaatggcaagtccttttttttgacctcccatattcccctcactctgagttaaacactctgaaagaaacatatccagccattccttctgaaaatgtcaagcaaacaaatgaaacaagaatatgttcaccttaggcaagggtttggctggtttacagtgaagtcctccaacaaaatcaacatttggtaagaatgggcgaggaaattcaaaatcccaataggttcgaatgagccacatttcagctttccccattgtctcaaataatgtagtgggtcttcctgatggaaaaaaacaaaacaaaacaaaaggtagctaacacgagaattgttattttaatattgaatatgcaggtattttcctgaaaggacttggaataacatacctaaaaatatataaaatgtctgcacattgataatatatataaatacatttatataatataatacattatattaaatacattatattaaattaatgtatattaaataatattaaatacattatattaaattaatgtatttaatatatgttaatatattttaatttaatagtatttaatttttaatttttaatatttaataaagtttaatatttaatattaataaaattttattaattttattttattaataaaacattaataaagttaataaaattaaacaatatttaatatttaatttaatatttaatatttaatagttttaatttaatatttaaattatttaataaaataatttaatataatgtaaatacattatattaaatacatttatatagtcatcatttaatttttatgtattgcatatgttgctcatatgtatatataaggaaggcaaagtgttcagagagctgtaagaagaaatcacatctttaatgtaacatcagtatattcacaatcataaataattattaaaataagtcactaatatggtttgactgtccccacccaaatctcctctcatcttgaattataatccccataatccccatgtgtcgagggagggacccagtggcaggtgattggatcatggtgtggattcctccatgctgttctcatgatattgagtgagctctcatgagatctgatagttttataagtgtctggtatttcccctgcttgcacttctctctcctgccactaagtgagaagatccaagcttgcttccccttagcctttcaccatgattctaagtttcttgaggcatcccagtcatgtagaactgagtctattaaacttcttttctttataaattgcccagtctcaggtatttctttacagcagtgtgagaatggactaatgtagccactatgaacttaaatacacatttgtcttccctctgaagctgcaatagtaacaaatatacctttaaacaactctttcagttccacaattaattcatcttaccttacccatgaaaacagctttccaggaagtactctagtgtctacagtttattaagctagtcccttgatccttggttctcaaagtaaaccatgagttttttgagctcaacactgaaatctttacacctactactgtcttggttcatcttaagatcttaatataattagatttttaaaataaatatatttacaaatgagaattaaaaatttttcagaatttattgacatagagatatgtgctcttccttattttggcccctattttctttgatggagagatgcagtttaataaaatatagattaaaacttagatgttcactttcaacaagatttcagtttttgaaggaaataattgtgaagttgttattgaaggaatgtataaatattagaaatctcaagttttaggcttctgtttctggagtagagccactatatttctcaactgtgaaggaatccttcttatatgaaaaacaaaatttaatttctaaatgaggaaactgaggtactcaggtacaagttcctcaatcctgcattgataatatttttagaaatatgtgtaaatataaaatttgtatgtctgccttcatgaagatgtttcttgaagtatctattgacttttttaaagatgaaaaaatgtatagcaaaatgatatgtgatggcttaaagaaatcataagtgttttacattgaaggtttatgactctcttggtgtcctatagcagtgatggcaccagggttctaactgattctataaggtcaacattctatatttttgagactcatagatcatcttacatttgcaattcataatttcccataaaaacactatcttctgacattatatttatataagcccaccttcaaaggcacaggaaaattagaacttaataaacaccaattggacacacgacttacctagaacttcactataaaactggtcccacttcttcagatcatatgcttgaaaccaaaagtcaaaataaagcatatatatcatattttttatcctctccatgaaaatcatttgatcacttaattctgacataacaacaggtacataggaaggagggaacagaaatcctccaccattcttctcaactgtgtagccaacagagaagcggagactgtacagaaagggtatgttaagtagctcagccagcagctcaccacagggattaacggcatctgccagaaggacatcaaattttgactcttgtagttttctcataagtttcttgttcaaaactgcatcttcacagagctttatattatagtcagaatattcccaacacaattcttgtagttgtgaaaaatatgaccaaaatgtattttttgaaatactatatgtccatctatcgaacattttcataaaaaaatcttccaaatcatttttagttaaagatgtaggataaacttctaatttaatagcagatgatttactggcattgacaagaatagaagccgaagatgtcaacacaatcacctcatgacccctctgaacaagctcttccaggattgtcttcatatttatccaatggctgtattctgtgggccacaccagcacctttccacaactcccagagctaaagtaacaactgagctgcatcagcagaaagactgacatccatttcagagacatcctggtcttatgcagtgcttcttttccagttgttgtttctttctgtcatttctcatacttatatctgaggaaaaatcaatcaagttaaaatataactgctaaaatttgagttgacctcatatttattttagtgtgtttggtgttcttttatatttacaattactctagtcaagcaataatttttatgacctagaatacgtaagtaacctgtcttatgtaattattttataatactgttaagaacagtggcaggtgagaggctcctgcctgttcggtgcccttgacatagagagaagaagtaattatacaactcaaacgccattttttaatatcgtggtgcaagtaatgtcttctaaaactttgttgacacataattcatataccatatgactcaccaattagtgtgtacagttcaatgtttcctagtatattcacagaattttactttcactacaataatcagtattatctccaaaagattctatacaatagcctctaaccccccactctgaaattttgcatccatcctaccctaggcaaccactaatctaatttctatctctatagattagcattttctggaccctttaaaaaataaatgagggttttccagtgatcatggcagatgggatgcaggactagattgcagctccagacagagcagcatgcagaggcttgcattgtgaattttagctgcaggtcaactgcaaggacagaccagcaattctgagaggatccacacaccctctgcaggaagcgtactgctcctgcaggacctgggagacatcccaaacactgtgagtgccccaacaatggaagtgggaaagggtgatccccctctccagaatacacatccccactggagaagctgaagttctgtttgcaggagaagttcctgactttatgtgaagctgagtcaaattagagaaccaagccaagcaaaatataggggtagaggaagtagcagaaaggtactgggagctctctggatacccaagcagctcattcctgcctggcaccacagtgatcctttaggagggtggccagcggagcagggggttcaaagattcttctggggcctgaaagcttgaagggatgagtaactcctcccttctcaggcccagtcccaagatgcaaggctgcttgcatcagcagcgtgtgtcagcaagatagcagaagcaggaagagagccggccagaagacacctaccctggctggagacatgaacccttgaagatcaagaggccatccagatactacatagcagtcacgttagattgggacacttactctttacagagaactataaaaccactgtcccatcctcacttggggctgatgccattttaggcctcagcccacctgcacccaggcactcattaaaacagcacgctgctccgcactgcctcgtgttgtctgttggcatgctctcagggatcaaaccaattcaagaaccttatatctggtgccaaaacctgggtggggctcaggtctgtgtcccttgtggacctacccctccaccccagagagcaagccacagcaaccagacaaaggaaactcctcagcctccagttgcctctctgtgcatgtgtagcaggatgagccacagacaaaacttctcagacaccaagttgtagaaggaagggctttattcagctgggagcatcggcaagctactgccttaaaatccaagctcctcaagtgcgcaatttttgtcctttttaagggctcacaacactaaagatttcacatgaaatggtcgtgattgatttaagcaagcagtgggtatgtgacaggtgctgcatgcactgctggtcagagagaaacagaacagggcagggggttttacagtgttcttctgtacaatgtctggaatctctgaataacatcggtttctaagttatgagttgatttttaactactgggtttaggtcaggcaggcccaggcctggtttcaggcctggagccaggctgcctgtctttggttttacttctttgttgttttttcttaaaacaggtactgagcataaaacaatataaaataatctgagagggtccttctcttccttcattccccccttttgagactctcactttttattagtgggagttctcactcatttttttacttatgtctttttgtggaatagactgatagtgattcatatagtacagttgtgctgaagcattttgttgaactaaggtagcgatgaagctttttatcatttgaagaagtacaggtagcaaacaagggagcagtaagcaggtttttataattattgtaactcctattataagagttttaaatttttctagtgctgggaaccactttctaaacatggcttcagggttgaatccgtgctacacttgcacaggtacatgtgccagttttgtcatatttttaactatgtctttaataacttgcctgattatctatgtgtagacagtaattagtaaggttaaatttttcacaaactcctccttcagctgctagcaagtagtcaagagctagtctattttgatagattgcatttctcatctgagtctcttgccgggcaagaacggtcaaggcttgaccggttttattagtaaaaatttctaaaacagcttgtaaccatatgattcggttgagcatgtagatgggggtccaatatcctcatgagccatcttgtgcctaagtggcgggtccatagtattgtatgatttttttcagggggctatttatcatcttttcctatggctatgcttcatttttttgttcccaggaagcatagactgggaagcctagaagttcatgtttttatgggcagtaagaagaaagaaggcttaatggtgcgaattacacagctacctgtctactgatcaggcagcttagcataagctttgtgtccacatatatccagtataatccggtgggggccgtccagtcccagtggaattctgggtgggcccaaacagtctgcaactttggaaatttactgaatggatttctttctgtgtaattggaactccaccatgtgactgtttttgtggtactattatagagcttttgtctaagacagctaagctgccttacaggatgagtgaatccttttccttctttagctatgcaatactgtctaataattgagacttttagaacctagagatgatcagggtgattcttttgggctgggaattcatcaggaaatgggtctgtaggaactaattcttgggcttcctatggccattgatctactgttatggttcctccacaaacataatatgaggtgacttgtagagactgggctacgtgttaggctaattgcaaaaagaaatttttagtttttcctggaatctcaggtactggcacatttagttcatcatagaaagtctgaaacactggttctggagagcgtttttgaacctctccttttattaggatgcttacattaggatctagtccctttttatccatgtctaatgatatatatttttcttttattttactttgggtctgaggggtttgtgattatcaattctaaaaggttgtagctcctattcatgcaagaggggctgagttttcctttttggagtcaaacacgatcttttttattttccttttaagtagtctgaatgacacgagaccagtattgacacatctcacataaatatgatttttgacagatatacttattttttttactgtgtaactttcttttttaatttagagaatcacatcctgtttcatgctgcttactattaatagcggcacaagtgtcaaattttaaggttacattttgaggagctctgtttttttcggttctacctattaccttacttgtgtcacatagaaaaggagcagtccttaattttattttaaaaactgtgatcatgggaggcttaaaattgttcataacacacatcaggttggttatttcctgggctacataccttggatagaatagcattatacaaacaatttgttgttgtttttgttgctatttaatttttttagagtcctcgggcgtccgtgatattagtgttagtcagttttgttgtgagtgttagaaagagggcatatagaaccaggaagctgataagaaagacgattatgagggcgtgatcatggaaggcaattagctcttttataataaccataaagtaattagctcttttataataactataaagtaataggactgtagcaatcttttgttccacctcagtgacttgatgtatatactggaaacagttcttagtctgaggaaggtcagttgaagtccttcctgtacaagtccaaattctgaggaaaatgagtcctgcgatgagtctcctcatgcttcagccatgcgtggaccagtcagcttctgggtgtgactggagcagtgtttgttgtcttcttcagagtcattttgcagggattggtgaagctgctcccatccacgtacagctcccagtctactgatgtacagttatgtttaactgggctctctgataataggagtaagatagtgagcttagggtgttgcaaacttcaatggttatgtggggattttcacaatgcaagctttggtatctagttagtctatcatttattagctaatgatgtcctttggtatttattaaaattaccacagcatggggagactttatgtttaggtttttcctaagagttagcttatttgcttcttgtgttaacagggctgttgctgccagggcccttggacatgggggccagcctttggaaaccccgtctagttgttttgagagacaggccattggccttggccaggaacctccagtctgggttaaaactccaactgccatttttttctctttctgacacatagagtgtgaagagttttgtcaggtcaggtagcctcagggctggggccgacatgagttttttttttttttttaactcatgaaaagctctttgctgttggttgtaatagatgtagtttatctaatctacatttttattgactgttatctactaaaatattgacttaaatcttgtaactatttgatttcaagctttaaattgatctggtattccttgcagggcttcgattgcatctaaatagatgtgagagttgaaagacttataaggggctcctctcactttacgatgtgttattattattttttccttcctctggttgatgaaatgccagggtgaaagggatagcccaatggactaaggcacaaatgccactctagttatttggcagagtgcctagtaaaggtccaccacaatactaccacacatctgctcagggatgaacaagggctgattgattgataagctcttgaaaattcttaagctcactgcatccttttaggtctccaaggaatgctaagtttcctccctgccgtgagagacaggaagtgaacttagtgttgagagacagaagctggatggcccttgggggctgactggcagggacttcaggatatagcagagagagcttggcatgacttattactccaggctgtagaatcctggaaaagagctaccatcaggcccacacctggtgaactggaggaccaccgtagtgggaaggggacaattagggcctctggcctgccatgtgcacaagcataacaattgcttttgtttattgtgtagttggaatatttgatccatttcaaccaggcatttgtagcttgatatactgtcttaattgctaaagtttgttttaagtctttaacttttatgatcctctagtaaaatgaatatttccattagcactaatttttattagtttttagaccaaagaaagctaaacatcattttatatttaatgtttcttgtatgatttttataccagataagctaaattttacttttatattagtgtgttattaatattaaacttaattttaataaaaccttgtagacatatttatccaatttttcatagttgaccataaggtaagattttatagactctgtttaaccttttacaatttttgttaaagagcaggttgatgctttaaggaaaaaacctgttgcatttttactttcatgtctagttcacagaaaaactggataatacttttttaactttagctaataagtttacacacagaattttctttaaattaacattttaaaacttgcttgaacttttcaaacaataattcttttttgactttttaatgtaggtaaaaatccacattcttatgcctccttataatcttctcattaaagttatattttacttttttatacacctgcacataaactgtttcttcaatagcactcaggaggccttattacttttaaattatgcaacattttttgcataaaattttttataactttttttcacgactttcgccaacaatttttcaacatgtctcaactttctgacttattacaaacatttttttcttctctttaaacaacaagttaatttatttcaggacaagaatttaccatataacactctttttacataaattttacctcctccccccccttttttttttgaagataaccattccttttttttaaaaagtgaactttctttatgtctttggactagactgtctaaggccacaagattagaagttaccataatatgtgttacactgtcaacttttagcaaacttcgcttttgttgaaaaccttgtaagtttgaaatttcaattatcctttgctattaataagaccttgtttagtctaaatttacttagaattggtatagatggccttttttttttttttctctgctggtctttccttgcctctgccagctgcttatgctgctgttctcttaactattgtgagggggggtggggggaaggggtctaaaaccagctgtaactgtctatgtacagaacctggtctgggtgccttggcttacaggttaccttgtgccataccttagaaactaaaaagacctatctaggcttccttctgatggctaacctacctctaatgctggccaatctatttcacacaaagttctaagttttcctggagtcatagtgactccatagtctctattaaatcctttcttgaaattcattatcatagttcccagtgcagtgggcttactttgtgcctgatctatgtttttttgagacaaaacaccatgctcacagcacacacacaccacaaaacaaagaacgggtaaaagggcacacacaaacatttcagtttacaccaaaccaaaatcaaaaccaaaatcagagtatccagaaatccaagccaggtcaaaaaccaaaaccaaagtatccagcaattcaagtcaagtcaaaaccagatcaaaagtgccaatacaggcacaccgtgggtgatcaggctatgctacacttccattcaggtggagtggggcaagttcaaaagactagtcctaccaagtctagccaagtcaaaaccagaacaaaggtgccaacacaggcacaccgtgggtgaccaggccatgcttctactcaggtggagtgggacaagttcaaaagactagtcttaccaagttccagatgtccagactccaagtgccagttccttcccggtgttcagccactgtgttaatcctccacgggggcctgctacgtgttgatctggtgaggtgttccactggggcaatttcctacccaggagcgctctttggatctcatcactcaggctgcccggagtaccccacagggatgctccacagggcaggcttaagccacctaaggggctgcctcagccttccgtcagtcaccttgcttctgggtcagggagccaagaaatgtagcaggacgagccacagacaaaacctctcagacatcgagttgtagaaggaagggctttattcagctgggaacattggcaagatactgccttaaaatctgagctccccgagtgcacaatttctgtcctttttaagggctcactacactaaagatttcacatgaaagggtcgtgattgatttgagcaagcagtgggtatgtgacaggggctgcatgcactggtggtcagagagaaacagaacagggcagggagtttcacaatgttcttctatacatgtctggaatctatgaataacattggtttctaagttatgagttgagttttaactactaagtttaggccaggcaggcccaggcatagtttcagtcctggcgtttgggctgcctgtctttggttttacttccttgttgttttttcttaaacatgtactgagtgaaaaacaatataaaataatatgagaaggtctttctcttccttcacatgcacattggtcactgatctcgcctactgttaggcttccctgggagcccagttaacaggggaaaatctgcatgacctctcttggtttctcctgtcccaaaatccaacactgatccaagaaggctccagtatgtgccaggcactccctgatcatctggtcttagggggacgcctctaagccatttgattccgttccaggaaccaaaaaggcagaggtgataatagctccttttattgtcttcctccagctgtccaggacagtcttctttttccctgttctccagagcctaccctttgatatggaaaactccccatcctccattccaaaaaacagccctccagactgcctcataaaaaatctgcaaaccttaggcctcaggcaagatacccaccctaagcgccttgtcttttttatacaataaaacctggccgcagtatgaattagataacgggtccaaatggccagcaaatgaaacacttgactttacaattttaactggttaaagcaattattgccgatgactggaaaaatggggagaaattccttgttccaggcctttttgcactcagatcacaacctgacttctgcaattcttgcttacctgttcaaatccttcattctcaccgccctcataacctttctcctcctgaccctacctctttttccttgttggatccagcagactgctgtccacccctcccagcccctacccccacgtctcaaccatcttctataactccccaagctttctcattgtcttcgcagtcaccatcttcccagccaccatcttcccagccggcatcacctccaaaagtacccacttctttttctacaccgtcctctcctcaggaaaactctagcattgcctgtactcagtctccttcctcactgccctctcctgaagcctgtaaacccatcaagccaccttacacccctatgtatcctccactgcctgtcaactcaacccgccttcccccttcaaaccctcagcaggaaccccttctggcttctttcttctctcctgtccataccagcttgggcaccatctttggcccacgctgcacccatacttcagtgcgggtgctagaatgcccccttcaggaagtagcaggaactgaaggtattgttagagttcatgttcccttctccttcactgatctctcaaactaacaagactcagttcatttccagaagaccctacctcttatattagggagtttcagtaccttacccagtcttatgcactaacctggtatgacctctacttatcctgtcttccaccctcaccttctacttatcctctcttccaccctcaccccagaagacagggaccatatttggaccctggttcaggagcatgctaatacaattcatcatcaagctcctgcccagcctactggcacggaggcagtccccaaccaggagccccaccaggattatcaagacagggcctctggacactgccatcaagaccacatgattgtgtatctccttgcaggactcaaaaagggtgcccataaagtggtaaactataaaaacctttcagaaatcacccaaggtcctgacagaaacccagccttttttctctcttgtttaactgaagccatgagaaaatataccaacctagacccagccaacccagaaggaatcactattttaaacctttggttcctcatccaatctacccctgatatttggtgcaagattcagaagcttgacaatggccctgaaaccccacaatgacaccttcttaatttagtcttcaaagtctttaacagttataacgaggaaagtaaaagaaaaaaaaaaaagacagagtttcaaatgcttgcctccaccatcacgggccctgcaggcccacaggctgcagctccacacagatgcctcctagcaatccacctccccctggcacctgtttcaagtgtggcaatgaaggccactggtccaggcaatgcccaaacccaggtaagcccaccaggctgtgccctctctgcggaggaccccactggaagtcagactgtgaggtgccccagcaaggaccgcccccatccctgccccagccggccaaaacctcctactaggatctcatcagccttgccgctgaagactgacagtgccctggaacagatgccccagcaactaccattgcttcatctgagccaaggataaccttgatgttggcagataggccagtattttttttttaattaatattggggcaacctactctgctttacctaaattttcaggacccacccagtcctcccaagtctctgttgtgggaatcaatggacaagtctccaaaccccaagacccccctccacttttctgctccctgcacaccttttccttcagtcactctttcttagtcctgccttcatgcccagctctgctcctaggcagagatattctttcaaaactccacactactctccacttccacattccccatagtacccaacacatcaacccagacccctccaaggcttctaacaggcttctaactttcttctactcctccgacctcccaccctgaagcatgcaacttttccttatcccgcacctgtagttaaccccactgtttgggatacttccacaccctcggtcacagagcaccacacccccatccacatcacccttaaagagcccaccccgttcctatcacagaagcagtatctcatcccccaagcagctctcataggcctaaagcctatcatttctctcctcctcaccagtcacctactctgcccaacaaactctccttttaacacatcagttctacctgttaaaaagccagatggaacttatcacttagtccaggacctcaggctcattaaccaagctgtactcccagtgtgtccagtagtttctaacccatatactttactttcctcacttccctcgaataccacccatttttctgttctaaacctaaatgatgctttttcacaattcctttacaccctgattcccaaaatctctttgcctttacctgggagaaccccgacacccacctttcaggtcagctcacctcgtgtgtactacctcaaggttttagagacagcccccacctttttggacaggcccttgctagtaacttctgtactttatccctaaaatcatcctctcttctttaatatgttaataatctgctcctgtgtagcccctctcaaagagactgcaacacccatacatactatctctcttttaaacctcttggcagaacaggggtatcaggtctcccctaagaaagcccaaatatgcaccccccagtcacctatctaggcctagctctcactcctgaacgcaagggctcacaacagaccacatattccctccttcagtccctcccgcctccacaaactaagcaagaaattctctcttttccaggattagcgggatattttaggctctgggtttcctccttcgctttacttgccaaaaaattatacgaagctgttaaagtccctctctatgagcctttaaaacctgcacagcctattacccaacctttccatctactccaaaagtctctcatctcagcccccatcctcactctcccagacttcaccaaacctttctccctttatactgatgaatggcgtggagttgcactaggtgttctaacccagtctaaggggcccacccggccaggttgttgcctacctccctaaagagcttgagaccacagttcttggatggcctgcctgcccctgagcattggtggcagctgctctcctcactcttaaaagcctaatactatctcttcatgccaacctaacagtttattcaacccataacatcaaagacatgttagctcaccgcagtgtactaagtcttttctctgccccacggctcctccagctgtatgctctattcatagaaactccccacatcaccatgctaaccacctcccatctaaacctgtccatgctcttacctgaagctacaactgcccaagactctacactcttctgtgtgaatactgttcaaacctttcttataccttttccatacctaacagaccaatcccttccagatgcctcctttatttggtttgtacatggcagctccttcctacatcaaggacactgacatgggggctatgctatagtgtcaccccccaacactattgaagccaatccgctcctcttaggcaccacctcccaaaaagctgaattcaatgccctcactccagctctcactctagcatccggaaaacagatcaatttattcaaattctcattatgcgctccacgtagtgcactcacactcatccatctggaaagaacggggtttcctaactgcaaacaatactcctgtcataagacaagtcttctagtccttgtctgtactttctctgggtaggtagaagaattcccaacaacttcagaaggtgcaactgtcatcgcacaaactcatcatgcatacctgcaattccccgttttggactcccaacatccatccagtctgataacagtcctgccttcatcagccaaattacccgaggcatctctacatccttaagaataaagtaagctctccacacaccctacaggcctcaatcttcaggcgaagttagaaaaattaactctgtctttaaagcccaactcaccaagctggctgtagaaacccaacagtcgtggacaaaaaaaatctccctttcgccctcataagactttgcacaacaccaaaagcacactctttttatagtccctttgaaatcatgtatgaccaaaattttgtcttggggcctccacccttaccagactctgagccactcagaaattaccacccctccttaatccagacatggtctttcatttgtgaagcagcaaatgagccatgcctctccctgtcgacacctcctggtcctctcaacataactgacttgcaggcacagacatgtttccagacaatacagatggtgctcctgctacagcgacatggtggataccaacctgtctctcaagaataccccaaaaattaagttttttttttccaaggtgcccactccaatccctgtgtcatgcctgaagtagttactgagaaagtcaccccttttccctttattctataaccaaataaacaggaagattctccctggggcctgaaagcttgaagggatgagtaactcctcctctcaggcccagttccaagatgcaaagccatttgtgtcaacagcttgcatcagaaagatagcagaagcaggaagagagccaactggaagacacctaccctggctggaagacacatacccctgaagatcaagaaagagaccgtctgggtactacatagcagtcacatcagactgggacacttactgtttacagaggactacaaaacccctgtcccatcctcacttggggctgacgcccctttaggccctagcccacctgcacccaggtgctcattaaaacagcatgttgctccacaccacctcgtggtttctgttggcatgctctcagggtttgaaccgatacaagaacattacaggggtaaaactccacagtaagagggacttctctagctgaactttgtaacaatttgaacaggcaagaagcctcatggccagaaattgggggagggcatgaatctagcttgcagacttcacaggcaggggaagaactaaagcccttttctttgcagctgggaggtggaaaatctcaggcaaatattcaagtccaactctccctcctccttgaaaaagactcgggactattgcaggggccacggtggaagtgggagtggcccttcagtgtgcatgggaggtgggttagaactgagactgctggctttcccacacttccctgacgacctcatgactcagcagaggcagccaaaatccacctaggtacacaactccagtgacctgagaatctcacctccatccccagcagtagccaaagcaaggccctcccaaggaaggtctgagctcaaacacgcctggacctggcccacctggtggtccttccctacccccctggtagcagaagacagaggacctacaatcttgggagttgtagggccgtgaccaccaccagtccctctccacaatactacagctgatgctttctggaaagtaccacctcctggcagaaggccaatcagcagaaaatagagcattaagccaccaaagctaaggacccccacagagtcctttgcaccctccacctgaacaggcactggtatccacagctgagagatccatagatatttcatatcacaggactctgcagacaacccccagtaccagcctggagctggatagacttgctgggtggctagacccagaagagagacaacaatcactgtaatttggctcacaggaagccacatccacaaaaaaaggggagagtaccacaacaagggaacaccccataggacaaaaaaatctgaacaacagtcttcagccctagaccttccctctgacagagcctacacaaatgagaaggaaccagaaaaccaacctgggaatatgataaaacaaagctcgttaataccccccccaaaaatcacactagttcaccagtaacagacctaaaccaagaagtccctgatttacctgaaaaagaattcaggaggttagttatgaagctaatcagggagggaacagagaaaggcaaagcccaatgcaaggaaatccaaaacataatacaagaagtgaggagagaaatattcaatgaaatagatagctgaaagacaaaacaataaaaaattcaggaaactttggacacacttttagaaatgcaaaatgctcaggaaagtctcagcaatataatagaacagatagatgaaagaaattcagagttcaaagacaaggtcttcaattaacttgttccaataaagaaaaagaaaaaagaaaaagaaaatatgaacaaagtctccaagaagtctaagattacgttaaataaccaaatctaacagtaatcggtattcctgaggaagaagacaattcgaaaagtttggaaacatatttgggagaataattgaggaaaacttccccagtcttgctagagacctatacaagaagcacaaagaacacctgggaaattcatcacaaaaagatcttcacctaggcacattttcatcaggttattcaaagttaagatgaaggaaagaagctgggcatattggctcacgcctgtaatcccagacctgatcaggtggtcggaggtgggtggacaacctgaagtcaggagttcgagaccagcctgaccaacatggagaaaccctgtctctactaaaaatacaaaactttgctgggtgcggtggcacatgcctctaatcccagctactcgggaggctgaggcaggagaatcacttgaacccaagaggtagaggttgtggtgagatcatgccattgcactctaacctgggcaacaagagtgaaactccatctcaaaataaaaaaaaaaaaaagatgaaggaaagaatcttaagagttgtgagagagaagcaccaggtaacctacaaaggacaacctatttgattaacagcagatttctcagcagaaaccctataagctagaaaggattagggccctatcttcagcctcttcaaacaaacaattatcagccaagaattttgtatccagtgaaactaagcatcatatatgaagggaagatagccgttttcagacaaacaaatgctgacagaattcgccattaccaagctaccactacaagaactgttaaaggaactctaaatcttgaaacaaattctggaaacacatcaaaacagaatatctttaaaacataaatcacacaggacccaaaagatcattcaaggctgctatgaacacctttatgcacataaactagaaacttagaagagatggataaatttctggaaaaatacaagcctcctaacttgaatcaggaagaattaaatacactgaacataccaataagaagcagcaaggttgaaatggtaatttaaaaattaccaacaacaaaaagtccaggaccagacagattcacagcagaattctaccagacattcaaagaagaattggcaccaatccttttgacattattccacaagacagagaaaagaggaaccctccctaattcattctatgaagccagcatctccctaaaaccaaaaccaaaaaaggacacaaccaaaaaaggaaactacagacctatatccttaatgaacatagatgctaaaatccttaacatgatactagctaaccgaatccaacaacatatcaaaaagataatccaccgtgataacgtgagttttacaccagggatgcagggatggtttaacatacacaagtcaatatatgtgatacatcacataaacagaattaaaaacaaacatcacatgatcatctcaatagatgcagaaaaagtgtttgacaaaatccagcatcattttatgattaaaactctcagcaaaactgacatacaggggaataccttaatataataaaagccatctatgacaaacccacagccaacgtaatactgaatgggaaaaagttgaaagcgttccctctgagaaagggaagaagacaaggatgcccactctcaccactcctcttcaacatagtactagaaatcctagccagagcaatcagaaaagagaaagaaataaaggacatccaaatcagtaaagaagaagtcaaactgtccctgtttgctaacaatatcattgtttaccttgaaaatcctaaggactcctccagaaagcacctagaactggtaaaggaattccacaaagtgtccagatgcaagattaatgtacacaaatgagtagatcttctatacaccaaaggcaaccaagcagagaatcaaatcaagaactcaaccccttttacaatagctgcaaaaaagtaaagtagagtaaaatacttaggaatatacctaacaaaggagtcaaaagacctgtctacaaggaaaactacaaatcactgctgaaagaaatcatagatgacacaaacagatggaaaaacatcccatgctcatggatgggtagaatcaatattgtgaaaatgatcatactgccaaaagcaatctacaaattcaatgcaatctccatcaaaataccacgatcattcttcacagagttagaataaacaattctaaaattcatatggaaccaaaaaagggcccacacagccaaagcaagactaagcaaaaagaacaaatctggagccatcacactacttgatttcaaactgtactctagggccatagtcaccaaaacagagtggtactggtataaaaacaggcacatagatgaatggaacagaatagagaaccccaaaacaacacaaatacttacagccaactgatctttgatgaagtaaacggaaacataaagtggggaaaggacacccttttcaacaaatggtactgggataattggctagccacatgtaggagaatgaaactggatccttatctctcaccttatacaacaatcacctcaaaatggattaaagacttaaacctaagacctgaaactgtaactctagaaggtaacattgggaaaacccttctagacgttggcttaggcaaggatttcatgaccaaaaacccaaaagaaaagcagtaaaaccaaagctaaatagctgggatctaattaaactaacttttgcacagcaaaaggagcaggcagcagagtaaacagacaacccacagagtgggagaaaatcttctcaatctatacatctgacaaagtactaatatccaggatctacaacgaattcaaacaaatcagtaagaaaaaaaaaaccccaataaaaagtgggctaaggacatgaatagacaattctcaaaataagtatacaaatgaccaagaaacatatgaaaaaagtgctcgacatcgctaatgatcaggcacatgcaaatcaaaaccacaatgcaatactaccttactccttcaagaatggccatagtaaaaaaatcaaaatacagtagatgttggcatggatgcagtgatcagggaacacttctacactgctggtgagagtgtaaactagtacagccactatggaaaacagtgtgacgattccttaaagaactaaaagaactaccatttgatctggcaatcccacttctgggtatttacccagaggaaaagaagtcattattcaaaaaagatacttgcacatgcatgtttatagtagcacaattcacaactacaaaattatggaaccaacccaaatgtccatcagtcaatgagtggataaagaaactggtatatccatatgatggaatattactcagccataaaaattaatgaattagtagcatttgcaatgatctgaatgagattggagattattattttaagtgaagtaactcaggagtggaaaaccaaacatcatctgttctcaatgataatgtgggagctaagctatgaggacacaaaggcataagaatgttacaatggattttagggacttgagcagaagagtgtgaggaagcaagggataaacgacaacatatgtggtacagtatgtactgcttgggtgatgggtgcaccaggatttcacaaatcaccactaaagaacttatgtaaccaaataccgcctgcacgccaaaaacctatggaaaaataaaaaaaatttaaaaaatgaaatcatacaatgtatggtctttagtgagtggcttcttgtgcttagcataatgtattaaaggttcacccatggaagagtgtatataaggacttcatttctttctattgtcaaatagtactccaaagtgcatatatactcattttatttgttcatttatcagttggtagacatagattttttccatttttgatgattatgaataatattgattaacatttatgtacaagttttctgtggacatatttttatttctcttgggtgtatatctagaagtggaattactggattacatggtaaatgtatatgtaaccttttgaggaattgctaactgtttttcacagtggcagaattattttccattctcaccaccaatgcatgatggctttaatgtctccataaccttgtcaatggttgttatcctatgttttttgattacagccagtgtgagtgaagtgatatctcattatgatttatatttccttcatatctaacaatattgagcattcttatgtgctaatttcccattatatattttcttagaaaaatttctattttgatactttgcccattttgattatttgtcctccttttatggacttatgcatttaataaatttttgacataagtcccttgtcacatatatgatatccaagtatattatcttatttttttggttgtctttttactttcttaatgatgtccattgaaacacaaaaatattaattttgatgaaatcctatgaatcaacttgaattgggtcacttttatttttagtgtcatatctactaaactatccccaaatgcaaaatcatggacattagcaaccatgtttcattattagagttttacagttctattgcttacatttagcttttaacttattttgagttaatttttgtaagtggtttgaggtagggggccaacctctattatttcgtatatggataatcagttttctcaattacatttgttgaataatctattctttgactcattaaattgggcactttggtcaaaaaccataaatgcgtgagtatattcctagattccaaaatctattacactgatttgtatgcctaccttatgtctgtatcacactctcttgattattgtatattggtatttgtctttaaaagcagaaagtgtaagccttccaactttgttttttattttaaattgtttcagctatttttttttcttctagcttttttttttttttttttttttttttaaggcaggggtctcactacatttcccaggctgaactagaagtcctgggctccagcaatcaatgaatttcagccacctgagtagctggggctacaggtgcatgccactacatctaaattgtttcagttattactgtctcctacatatctacatacattttagaatcagctagtcaatttatgcaagaagttatctgggattttaatagggattgaattgaatctgcataacaatttggggagcagagtatgggcattgtcacaatattaggtgtttcaatacatgagtataagatgccttttcatttatttagatatcatttaatttatttccataatgttttgtagatttcacagggcaagttttactctccttttgttaaatttattgatggccaggcgtggtgactcacacctgtaatcccagcactttgggaggcctaggtgggcagatcacaaggtcaggggttcgagatcagcccgacctacatggtgaaaccccgtctctactaaaaatacaaaaattagccaggtgtggtggtgcatgcctgtaaccccagctactcaggaggccaaggcaggagaattgcttgaacccaggaggtgaaggttgcagtgagccgagatcatgccactgcactccagcctgggctacagagtgagactccatctcaaaaaaaaaaaaaaaaaaaagagaaaaaaattattcacgaactgtatttttgtgctattttaattgtgattgttttaatcgttattttagcctaaatttttattgcaattagggagaaataactttttttttattgatcctatatcctaaaaccttgctttattggtttactgctctaatatttttctagcggatttgtaaatgtttactattataacattatgacaaaagccaataaagatagcttaacttgtttatttctagtatggagtcttttattctttcattttttaaaccaatttatcttatctagaacctctaatacagtgttgaatggaagtgagaaaagccaatttagtctttctccattaagtgcggtgtcagtgtgtgttttatttatagatactatttgtcagtttaaggatgtttctgaaaggtattgcattaatcacatgattttttctgcctttattaaaatgattatgcagttattgtccttattctaatgatattacatattcaccagttttttgagatgttaaagttagtttgcatttctggcataaaattcccttctggttaaagttagtttgcatttctggcataaaattcccttctgtatgtccaaagctttttgcacatgctagggttctgtttgctagtgtgaaagaaaaataaagaatcaagatcctaaagtcactatgccaaagggaaaaaagtttagcttgggaactgagtcacacaaactgtcagaggcattctaaccagagtgattccaccttgaataagtcagacaaggtcaaacctgccaggttacattcccaggggattgagcactcttggttacaagatactcatggttgagggaatgagttaatgatgataattaactaaataaagacccagaacttatgaaaatgtcccaatagtttgaaaacaaaaacttcttaatttaagaattagttttcctttaaaaaactagcccacttgtaaaatcttgctgaaatcaataatacataggaaaataacaatattaatagcctgtcacaagctgatcacaaacctttgtaataaagtacagtattcttaacaacctatataagcaagcactaagtttaaggtaggggtatttctcttcttgctttctgaggatgccctattctgtaatagagtagtctctaacaaactgttaattttactgtactctgcgactcaccttgcattctttcccacatgagatccacaaacccacccttaacgtctgggacaagaccacttttccagtaatattttcctctggtgactctgctgggacctaaatgaggtgagattccaacccaaaggaaatagactatgcaacaccaattggctgatttgggtaagtggtggaacatatttttatactcgaacagagacactgttcaaaatcggtttagaggcccaacttaggacagttagaggcccttctgacagataagaggtttagaggcctttccgaaagctaagggggttagaagcccttcacaacaagaaatgggttcaatgctacaaaatgttaattactactccctttcaattagccctccctgtgctctctgtcattcactaaagactgtctgctgtctgccaattttctgactgctgactatacttactgtttctttgcagagaccttgcttgatggtcctgagatttttaactttcacgttcctcatttgtctttggattagtggccctttacttgtgtgcttcggcatgttgctaaaagacattagagatgaatggctctgcaagatttactttccctatatctagcccattcgaatgaattatttattgtctcatctctcaaaagattaattgaaatttggtacttacaagttttggtccagtgtgcacgatttagcccagtagcaattatgccaatctcccatgggtgaacagctcccagaaggagaactggagatttctttttggaaattctttttcatcccctcactaatcaactgacctttatttcttgattatgaacagcatgatcatgtaagttttaccctacttaccattactatccttaacctggacattcctctctggatgcatatcatttcccttacttagtgtgacatttctttggtcaggccctctattgtagattctctagttcaggtgactcagctcatttatattatgcgactaacaagaatgccagaattaagtcaactactgaatcattttcccttgcttgtttagctctgaaagctcctttatcctttttagtgaagcttgccctgtggcagcactaccttgttcacaaggatctctaccttcacctgctctgctcctgtgtaatacagctttgatcctgaagagttctgagttctccactaggatgtctagtagagcattggaacaaatttcaattaggtgagcttaagaaaaataaattgacatttttatgtaatactgtttggcctcattatgatttggaatatcaagataaatggccacctaatggaaccacagcctttaatattatacatcaacttgatttgttttgcaagtgggagagaaaatgaggtaaaataccatatgttcaagcatttttattgcttagtcaggatgaaactttacagcaagcgtgtgcatgtttaatgaaaggaaggaaagaaaaggaattagatatactagatgaccctttaatgcaagtcccctgagtccaatgggtgcctttgggtggaacagtacctccctgtgtcagctctaatgcttcaggtgcatctccctctgtctcttctagcccttctagtagtcctgtttagacactttcattcccttctccttacccgtctagtctaattttatacctacctcattctgagaggcccagtcctattctgtaactgtcactccctgaggaggccagccttgctagtactacccagagtggagcctcttctcagtctccaaaggaaaatctttgttggcttagagaagtggcaaatggggaagagcgcactataaggtccctttccccatgttttttttttggtcttatgtaaaggttatttctctgaagacccaggaaaatgtatagataaatttgagaagctaatgctgacttataatttgacctggtaggattttcatattttgttatccacatgttgtacagtggaagaaaaacaatgaattttgggattagctagaatacattcagacaaagtactagcctgcaatcctaatgatatctatagaacaaggggtatttcagtgcctgattaagatctaggattgaactatcaaagaaataggagggcttacagaagagagatcatatgattacttggttattaaaagagaggagagatgtgtgaaaaagtctcttaattattataaggtgaaagaaattactcaaggtaaagatgagaatccagcattatttcagggaaatttggttgaggcaattagaaaatatactaaaattgatcccatttcaatggaaggacaaaccttactggggctgtattttataacccagtctgccactgatgtctgtcagaaactacaaaaagcagcctgggtctgcagacatctatgaatcaacttttcagtatggcatttatggttcttaataacagatacatggcagaggaagtgaaaaacttaagagagcctcctaaaaggcacagtttttagctgcagcattaagcttaccaaccacgtgagatcatccttacacttcttagccatggcaaaggaagctggaaggcagaaagccacaagctggggttctaagcactgcaccttgggtgtaaatcaatgtgctcactgtcataaaattggctattgaaagagggaacacccagcactccaaagtgagtctttggcccctgaacaaatgatggcagttcaagagtgacagggccctagagcttctgtcacagctcccattggacaattagccatatctccagaggagcttcgggtaatcattgatgtgacaggtaacaatattaatttccttttggacatgggtgcttcttactctgttttgactcatcataatgggccattatcatcccaagactctgtggtcatggggataaacggacgagctcatagactccattttccctatcctccaagctgctcttcagggactcttgttttttcgcatgcttttcttataatgcctgaatgtcctactccattttcaggaagagatttatgaactcagctgcaaactctggttttcttcagagatcacaaggcagatgattgattgcttttacttgtctcccatgataagggaagaaaaattaataggagacactctcataatatcttgctatctttacttataccctctttgcagaaagttgaaatttaaaaagggaaaagtaactaggcattcactagaattaggttaactaaaaatttctctgcagagctccttactaggcataggaactacagcaagcatcctgaaggagtctcattagagtgtcttttagacaattgctccaaatatgtccacatagtaaagaaaagatgacacagaacaacatacacaatcaagtatacaaccactacttggtagcattaggggaagttccatggatagatgcttgtaggagctataaaaagaagtggttttggaaggaatcaaaatgagacaaagaccttaaaactaggaaaaaaatgtatctacagagttcagggaatttctgctataaaaattaattgtaacaataaattgtaaaaaaaatgacaagaaaagccaaattgtaatgaaagtgatctgcctaggttacagcagaggcaatcaataaattattctgatgttctcacaatgcagaatatgaagaatgtttgcagaaatcaatacctgttgaagattaactaatgaaaaccaaatgaagaaataaccaactatatacaatatacaatagtatacaactatatacaatatacaatagtttacaatagtatacaactatatactatgtataatagtaacatttgcaccaaaggattatagatatagaaaataaatcaaaatgatgttttataataaacatagttcaaatgtccagagatgaaaaatagttcatataatatatgtatggaaaatgacgagaaccataaacataaaaagaaacacatcaattctagaaattagaaataaactcactggttacactaaaatgtaattgataacatgaaataaaatggaactgaatgaatgaacaaaagaacaaacaataacagcagtagaaagaactagtgaatctttctatttttctccctgaatcttgactcatagagccccaataggaatcacctaatactctaggaattgccactaagctgattaaaatataaaagtgttatttgttaaaaaagaaaaaaaagctgaattagtgctctcccgattgcctgctttattcccaaaactctcttatttctaattgttttactggtcttaatcattcatgctatgtttcactgaagtatttgtgaaatatttcatgtgtttatctcaattttgattttatctcaattttggtttcattctatcttgactcttgcaacctgcatgtcctcattttactttaccaatccagctccaaagacaaccttctcatagacctaggatttctcattaaatttttaccagtttatctgagcttcattgatcttgtttctctgccaattactctgagccactgtcatcatgacctaaaattttttcacaaattacaaatttaccctttataatttatctgtgtcaaggaagactctgtagacaataccagaagaaaaaaatgtgtgcagtacatgaatgaaaaacctgatgtttcctgactttttgatgattgtcattctaactggtgtgagatgatatctcattgtggttttgatttgaatttctctgatggccagtgatggtgagcattttttcatgtgttttttggctgcataaatgtcttcttttgagaagtgtctgttcatgccctttgcccactttttgatggggttgtttgtttttttcttgtaaatttgtttgagttcattgtagattctggatatgagccctttgtcagatgagtaggttgtgaaaattttctcccattttgtgggtggccagttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataatgtgtaaggaagggatccagtttcagctttctacatatggctagccagttttcccagcaccatttattaaataggatgtggagaaataggaacacttttacactgttggtgggactgtaaactagttcaaccattgtggaagtcagtgtggcgattcctcagggatctagaactagaaataccatttgacccagccatcccattactggatatatacccaaaggactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactatcgcaagaacaaaaaaccaaacaccacatattctcactcataggtgggaattgaacgatgagatcacatggacacaggaaggggaacatcacactctggggactgttgtggggtggagggaggggggagggatagcattgggagatatacctaatgctagatgacgagttagttagtgggtgcagcgcaccagcatggcacatgtatacatatgtaaccaacctgcatattgtgcacatgtaccctaaaacttaaagtataataattaataaataaaaaaatgaaaggacaagagtaggaaagtgtaaaaaaaaaaaaagaaaaacctgactgaatcataaacaaaaataggcaattagattaaaaatttagtatttgctaattaaatcaatgatagatttttatatactttggattggtaaaaattaatatcaccataggggaagaaccaactacctggccactccagtgctgtatagagtggcaatagtagaaagatacacacgggctcaacaaactctctctacttaaaactaaggtagctattactgaaatcaaaaattcaacctgctaatatgtaaattctgatcatacctttagagatcagagaagtgaccagtagtgaggctgcagacacaatgaaacaactctaatctcaccttgttatgaactgtatctgctcctgtgttgaagagcttcatttgcgtaagattttgctttttcttcatctgaattttactatgaggcaatgcacaagattttaacaacctatagatactaactgatatgatttggctgtgttcccacccaaatctcatcttgatttgtagcttttataattccatgtgttgtgggagggacctggtaggagataactgaatcataggagcagtttcctccatacttttctcatagtagtgaataagtcttatgagatctgatggttgtataaagggcaacacctcttgcttgggtcgcaatactcacttgcctgctgccatatcagtttcctccatacttttctcatagttgtgaatgagtcttttgagatctgatggttgtataaagggcaacatctcttgcttgggccgcaatactcacttgcctgctgccatatcaatttcctccatacttttctcatagttgtgaatgagtcttttgagatctgatggttgtataaagggcaacatctcttgcttgggtctcaatactcacttgcctgccatcatatcagatgtgactttgctcctccttcctttccaccatgattgtgaggtctccccagccatgtggaactgtgagtcattaaacttcgttcctttttgaattactcagtcttgagcatatctttattagcagcatgagaaagaccaatacagtaaattggtactaggccatagggcactgctataaagataccagaaaatgtggaagcaactttggaactgggtaacaggcagaggttggaacagtttggtgggctgagatgacaggaagatgtggaaaagtttggaacttccttaagacttgttgaacggctttgaccaaagtgtgataatgatatgaatgataaaatccaggttgaggtggactcagatggagttgaggaatgtgttgggaaatggagtaaaggtcaattgcgctatgcaaagagactggtggcatctagcccctggcctagagatatgtggaactttgaacttgagagagatgatatgaggtatctggtggaagaaacttctaagcagcaaaatattcaagaggtgacagagtataaaagttgggaaaatttgcagtctgaaaatgcagtagaaaagaaaaccccattttctggggagaaattcaagttggctgcagaaatttacataagtaatgaggagccaaatgctaatcatcaagaaaatggggaaagtgtttctggggcttatcagagaacttcacggtagaccctcccatcacagattgtagggaaaagaaagagagatcagactgttattgtgtctatgtagaaagggaagacataagaaattccattttgacctgtaccttgaacaattactttgctgagatgccggtaatttgtaactttgccccagccactttgcctcagccactttacctcagccactttgccccaactttgagctcacaaaagcatgtgttgtatggaatcaaggtttaatggatctagggctgtgcaggacgtgccttattaacaaaatgtttacaagcagtatgcttggtaaaagtcatcgccattctctagtctcaataaaccaggggcacaatgcactgtggaaagctgcagggtactctgcccttgaaagccaggtattgtccaaggtttctccccatgtgatagtctgaaatataacctcctgggatgagaaagacctgactgtcccccagcccgacacccgtgaagggtctgtgctgaggtgggttagtaaaagaggaaagcctctcgcagttgagatagaggaaggccactgtctcctgcctgcccctgggaactgaatatgtcggtataaaacccaattgtacagttgttcaattctgacataggagaaaaactgccctatggcagtaggtgagacattttggcagcaatgctgccttgttattctttactccactgagatgtttgggcagagagaaacataaatctggctacgtgcacatccaggcatagtacctccccttgaacttaattatgacatagattcttttgctcacatgctttttgctgacattctccttattatcaccctgctgtccgacacattcctcttgctgagataatgaaaataataatcaacaaaaactgagggaactcagagactggtgccagtgcaagtccttggtatgctgagtgctggtcccctgggcccacttttctttctctatactttgtgtactgtacagtctccaacgggcattatttttcaaaatacagaccttgtgcggtggtcattccttcctcacagtataattaagacttttacattgtatttagatgaaatggctgcattaattggtcaggcaagactatgaatagtaaaatcgtgtggaagtgacccagatgaaatcattgttcctttaaacaaggaacaggttagacaagccgttgtcaattctggtgcatgacagattggtcttaccgattttgtgggaattattgataatcactacccaaaaacaaaaatcttccatttttaaaaattgactacttggattttacctaaaattaccagacataaacttttagaaaatgctctgacggtgtttactgatggttccagcaatggaaaagtggcttacacaggccaaaagaatgagtcattgaaactcaatgtcactcagctcaaagagcagagttggttgctgttatttcagtgttacaagattttaatcagcctattaacattgtttcagattctgcatatgtagtacaagctaaaaaggatgttgagacagccctaatcaaatatagcatggatgatcacttaaaccagctgtttaatttattacaacaaactgtaagaaaaagaaatttcccattttatattactcatattagagcacatactaatttaccagggcctttaaagcaaatgaacaagctgactcgctagtatcatctgcattcataaaagcacaagaacttcatgctttgactcatgtaaatgcatcaggactaaaaaataaatttgatatcacatggaaacaggcaaaaaatattgtacaacattgcattcagtgtcaagtcctacacctgcccactcaggaggaaggacttaatcccagaagtctaagtcctaatgctttatggcaaatggatgtcacatatgtacctcatttggaaaattgtcatttgtccatgtgacagttgatacttattcacatgttgtatgggaaacctgccagaaaggagaaagtacttcccatgttaaaagacatttattatcttgttttgctctcatgggagtatcagaaaaaattaaaacggataatgggccaagatactgtagtaaagcatttcaaaacttcttaaatcagtggaaaattacacataaaacaggaatcccttatgattcccaagggcaggccataattgaaagaactaatagaacactcaaagctcaattggttaaataaaaaaaaggaaaaagagagtagaagtgtaacacttcccagatgcaacttaatctatctagcacactatactttaaattttttaaacatttatagaaatcagaccactacttctgcagaacaacattttactggtaaaaagaacagaccacatgagggaaaactgaattggtggaaagacatgaaaaataagacatgggaaataggtaagatgataacatgagggagaggttttgcttgtgtttcaccaggagaaaatcagcttcctgtttggatacccacaaggcatttaaaattctacaatgaacccatcggagatgcaaaaaaagtgcctccacagagacagaaaacctgcaatcgagcatcatctactcgccaggtgaataaaatggtgatatcagaagaacagaggaagttgccatccaccaagaaagcggagccaccgacctgggcccaactaaaaaagctgacacagttagctgaaaaaagcctgaagaacacaagggtaacacaaactccagagaatatgctgcttgcagctttaatgattgtatcaacggtggtaagtctccctatgtctgcaggagcagctgcagctaattacacttactgggcctatgtgcctttcccgcccttaattcgggcagtcgtttggatagataatcctattgaagtatatgctaataatagtgcatgagtgccaggccccacagatgaccgtggccctgcccaacctgaggaagaaggaatgatgataaacatttccattgggtatcattttcctatttgcctggggaaggcaccaggattcttaatgcctacaacccaaaattgattggtagaagtacctactgtcagtgccaccagtaaatttacttatcacatggtaagtggaatgtcacttgggtcacaaataaataatttatagcactcttcttattaaagatcattaaaatttaggcctcagggaaaaccttgccccaaggaaattcgcaaagaatcaaaagacccagaagtcttagttcaggaagaatgtgtggctgatactgcgatggtattacaaaacaataaatttggaactattatagactgggccccttgaggccaattatattatgattgtacaggccagactcactcatgttcacaggccccatctgtctggcccactaatctggcctatgatagtgatttaactgaaaggctagaccaggtttatagaaggttagaatcaccctatccatggaaatggggtgaaaagggaatttcatcacctcgaccacagttagttactcctgttactggtcccgaacatccagaattatggaagcttactgtggcctcacaccacattagaatttgatctggaaatcaagttatgggaacaagaaatcataagccatattatactattaacttaaattcctttgcaaagttgtggaaaacccccttatatgctagttgtaggtaacatagttattaaaccagattcctaaactataacctgtgaaaattacagattgtttacttgcattgattcaacttttgattggcagcaccgtattctgctagtgagggcaagagagggcgtgtggattcctgtgtccatggactgaacgtgggaggcttccccatctgtccatatgttaacagaagtattaaaaggagttctaactagatccaaacgattcatttttactttgattgcaatgattatgggccttattgcagtcgcagctactgctgtggctgctgtaattgctttacactcctgtcttcaaactgcagaatatgtcaataattggcaaaagaattcttcaaaattgtggaattctcagacccaaatagataaaaaaattggcaaaccaagttaatgatcttagacaaactgtcatttggatgggagattgacttgtgactggaatatgtcagatttttgtattaaacctcgagcctgtaatgaatctgaatatcactgggacacggttagacaccatctacaaggaagagaagataatattaccttagatatttcaaaattaaaagaacaaatttttgaggcatcaaaatcccagttaaatctggtgccagaaactgaggaaatggtgaaagctgctgatagcctcacaaatcttaaccccgtcacttgggttaaaaccattggaagttccactattgcaaattttgtattaatccttgtgggtctgttctctctgttgttagtctacaggtgtatccagcagttccagagagacagcgaccagtgagaatgggccatgatgacgatggtggttttgtcaaaaagaaaaaggggatatgtagggaaaagaaagagagatcagactgttactgtgtctatgtagaaagggaaggcataagaaattccattttgacctgtaccttgaacaattgctttgctgagatgctggtaatttgtaactttgcccagccactttgccccaacttcgagctcacaaaaacatgtgttgtgtggaatcaaggtttaagggatctagggctgtgcaggatgtgccttgttaacaaaatgtttacaagcagtatgcttggtaaaagtcatcgccattctctagtcttgataagccaggggcacaatgcactgcagaaagcgcagggacttctgccgtggaaagccatgtattttccaaggtttctccccatgtgatagtctgaaatatggcctcatgggatgagagacctgactgtcccccagcccgacacccatgaagggtctgtgctgaggtggattagtaaaagaggaacgcctcttgcaattgagatagaggaaggccactgtctcctgcctgcccctgggaactgaatgtcttggtataaaacccgattgtacatttgttcagttctgagataggagaaaaaccaccctttggtgggaggtgagacatgttggcagcaatgctgccttgttattctttactccactgagatgtttgggtggagagaaatgtaaatctggcctacgtgcacatccaggcatagtacctccccttgaacttaattgtgacatagattcttttgctcacatgtttttctgttgatcttctccttattatcaccctgctctcctactgtattcctcttgctgagataatgaaaataataatcaataaaaactgagggaactcagagactggtgccagtgcaggtccttggtatgctgagcgccagtccactgggcccacttttctttctctatactttgtctttgtgtctgatttcttttctcagtctctcatcccacctgatgagatataaccacaggtgttgaggtgctggccaccccttcacacctatggatatatcttgacaggtgggtcacacaaattgggaaaatttgcagtagaaaagaaaaccccattttctgggcagaaattcaagttgtctgcagaaatttatgtaagtaatgagaagccaaattctaatcatcaagaaaattgggaaaatgtttctggggcatatcagagaacttcacggcagaccctcccatcacaggcctggagtcctaggaaggaaaatggtttcacaggccaggcctagggccccccatgctctgggcagcttcaggacatgatgtccttcatccaagctgtttcagctccagccatggctaaaaggggccaaggtatagctcaggccattgcttcagagggtgcaagccccaagccttggtagcttttctggggtgttgagcttgcaggtgtacagaagtcaagaactgagttttgggaacctgtgcttagatttcagaggatgtatggaaatacctagatgtccaggcagaagtttcctgcatgggcgggaccctcatgcagaaactctgctagggtagtcagaagggaaatgtggggttgaagtcccaacccagtgtcgccactggggcaccacctagtagagctgtgagaagagggccaccatcctccagaccccagaatggtagattcactgatagctttcactatgtgcctagaaaagctgaagacactcaatgccagcctgtaaagtagcagggagggaggccctaccctgcaaagtcacaagtgtgaagctgcccaagaccatgggaacccactacttgcattagcgtgacctggatgtaagacattaagtcaaaggagataattttggagttttaatatttgactgcccctctggattttagattcacatgaggcatgtagcccctttgtttttgtcaagttctcccatgtggaatggctgaatttacccaatgcctgtactcccatgtattgaggaagaaactaacttgtttttgattttacaggctcataggtggaaggaacttgccttgtgtcagctgagactttggactgtggacttttgaattaatgctgaaatgaattaaggctttgggggactgttggaaaggtatgctttgttttgaaatgtgagggcatgagatttggagaggctgagggcggaatgatatggtttgtctccacccaaatctcaccttgaattgtagctcccataatttcatgtgttgtgggagggacctggtgggagataattgaatcatgggggcaattttttccatactattcttgtggtagtgaatgagtctcaatagatctgatttttttttttttttttttttttgagacggagtctcactctgtctcccaagctggagggcaatggcacgatctcggtttgctgcaacttccacctcctgggttcaagccattctcctgccccagcttcctgaacagctgggactacaggcacatgctggtacatccagctaattttttgtattttttttttagtagagatggggttttaccatattgcctgggctggtctcaaactcctgaactcaggcaatccgcacacctttgtctcccaaagtactaggattacaggtgtgagccaccacacctggcctgatctgatgattttataaaggaaacccctttcatttgggtctcaatgttctcttgcctgccaccttgtgatatgtgaatttgctccttcttgccttctgccatgattgtgaggcttccccagccatgtggaactgtgagtctgttaaacctctttcctttataaattactctgtattggatatgtctttattggcagcacgagaacagactaacacagtaacaaatgagaaatttataatattgttgtctgctataccacttttcaatttgttgaaggtggagatttttaagcagtaggaaatccttagatggttattacaaaataggatgattataatgaaaattaatgtgcttaaaataaaggttttaatacaatatcatcagaagttgggagaattaatggaacccctagaaagttcccgaaccctcagacttccaagccaatctgctccatttatcacagtttggagtagtttacaaagcacaaatgcagaaatcacaatgtgaaaatttattaacgctttcctcagataatattgagatattaatcaagataaaagtttgcaaaaaggcaagcgtctcttggctcaatcaccttgtacagacacaaaacacattaagtcctaatagagcctaagtaaaggttaatgaaatgaagataaaaggttatagaaaagttggtatatatccacaagctttatgtgaagtagttacatctcttttatctgacagtattattagaatggacattgtatctaactgggaaatgtttcccacatctagtattatacaatggaaggcatccaaatttgtctttaaatcattatgaattgggcattctaaatagaagccagtaagatattccatccaagttcatacagtgtagaatagaagctggagtgctgatagaaaaaaattctctgttcgatagccctatatcaagcataacttatagtaatatgctgtgagtatctcccagtgataaatactgggatttgggaaaggagaatttccacttgagtggcatttactaccttgctgtagtacattaattgaagctatccataacagttcatcaaataaccttgaaacatgaaatacccatgatgtcttgcataatgtaaatgaaacactccagtcatatagcagtacccagaagagttttgtactacaatggaaattgtctatatagaatcaaactgcgtcatgaatgcctgaaggagatattcttaagctcagaacccctttcctcctaggactgattctgaaactgtgtgaggagttgcctaattccacagtgctctataaatagctcacaactgactgacaaagatctgctaggcttgtagatggcacttacagggtgaatgaacaaactactgccatattgattctttttttctagttcttatgtaaatcctttttaaaaaaagggtttttttttttttttttttttttttttggaatggtctcactctgttggccaggctgaagagcatacaattacagtttactgcagcctcagcctcaaactcccaggctcagatgattcaccaacttcagtcccccaagtagctgggactacaggcatacatggccatgcctgacatttttaaaaagctttatttgtaggtatagggtctcactataatgccctggctggtgttgaactcctaggcttaagtccttctctcaccttagcctcctagaatgccaagattataggtgtgagctgctgctgtatctggtctgtaaatccttttttctgtcttcatcatttattggcttccttggaattaagggattatcttgttgtatgtttttatttcttcctttttatttttagggtatttattataggtgttctgtgcttatcataaggcttacatgaaaacaccttcttttttattatactttaagttctagggtacatgtgcacaacatacaggtttgatacataggtgtacatgggccatgttggcttgctgcccccatcaactcatcacttacattaggaatttctcctaatgttatatccctcctccagccacccacccccaacaggccccagtgtgtggtcctctgccctgtgtccaagtgatctcattgttcaattcccacctatgagtgagaacatgcattgtttggttttctgtccttgtgacagtttgctgagaatgatggtttccagcttcatccatgtccctgcaaaggatatgaactcatcattttttatggctgcataatattccatgctgtatatgtgccacattttcttaatccagtctatcattgatggacatttgggttggttccaagtctttgctattgtgaatagtgctgcagtaaacatacgtgtgcatgtgtctttatagtagcatgatttaaaatcctttggatatgtacccagtaaagggatcgctgggtcaaatggtatttctagttctagatccttgaggaatcgccacacagtgctccacaaaggttgaactaatttacactcccaccaacagtgtaaaagcgttcctatttttccacaccctctccagcatctgttgtttcttgtctttttaatgattgccgttctaactggtgtgagatggtatcttattgtggttttggtttgcatttctctgatgaccagtgatgatgatcattttttcgtgtatctgttggctgcatagatgtcttcttttgagaattgtctgttcgtatccttcacccactttttgatggggttgcttgtttttttcttgtaaatttgtttgagttctttgtagattctggatattagccctatgtcagatgcgtagattgcaaaatttttctcccattctgtaggttgcctattcactctgatggtagtttcttttgtcatgcgcaaaagctttttgtttaatttgatcccatttgtcaattttggcttttgttgccattgctttttgtgttttagtcatgaagtccttgctcatgcctacatcctgaatggtattgcctaggttttcttaaagggtttttatggttttaggtctaacatttaagtctttaatccatcttgaattaatttatgtgaaaagtgtaaggaagggatccagtttcagctttctacatatgtctagccaattttcgcaccaccatttattaaatagggaatcctttccccattgcttgtttttgtcaggtttgtcaaaaatcagatggttgtagatgtgtcgtgttatttctgatgtctctgttgtgttccattggtctacatctctgctttggtatcagtactatgctattttggttactgtagccttatagtatagtttgaagtcaggtagcaagatgcctccagctttgttatttttgcttaggattgtcttggctgtgtgggctcttttttggttctatatgaattttaaaatagtttttttccaattctgtgaagaaagtcattggtagcttgatgggaataccatcaaatctataaattaccttgggcagcatggccattttcatgatatttattctttctatccatgagcatggaatgttcttccatttgtttgtatcctcttttatttcattgagcagtggtttgtagttctccttgaagaggtccttcacatcccttgtaagttggattcctaggtattttattctcttagcagcaattgtgaatgggagttcactcatgatttggctctctgttggtctgttattgatgtttaaaaatgcttgtgatttttgcacgtccattttgtatcctgaaactttgctgaagttgcttatcagcttaaggagattttgggctgaaaagatgggtttttctaaatataaaatcatgccatctgcaaacagagacaatttgacttcctcttttcctaattgaatactctttatttctttctcttgcctgatcaccctggccagaacttccaacactatgctgaataggagtggtgagagagggcattcctatcttgtgctggttttcagagggaattcttccagtttttgcccattcagtatgatattggctgtgggtttgtcataaatagctcttagtattttgagatacgttccatcaatacctcgtttattgagagttttagcatgaagagttgttgaatttcattgaaggtcttttctgcatttattgagataatcaagtggtttttcattggttctgtttatgttatggattatatttatttatttgcatatgttggaccagccttgcctcccagctgacttaatcatggtggataagctttttgatgtgctgctggattcggtttgccagtattttattgaggatgttcgcattgatgttcttcagggatattggtctaaaactctgtttttttgttgtgactctgccaggctttggtatcaggatgatgttggcctcataaaattagttagggaggattccctccttttctattgattggaatagttttagaaggaatggtaccagctcctctttgtatctctggtgaaattcagctgtgaatccatctggtcctggactttttttcattggtagcctattaattattgcctcaatttcagagtctgtttctggtctatgcagagattcaacttcttcctggtttagtcttgggagggtgtatgtgtccaggaatttatccatttcttctagattttctagtttatttgcgtagaggtatttatagtattctctgttggtagtttgtatatctgtgggatcagtggaggtatcccctttatcattttctattgagtctatttgattcttctctcttttcttttttattattcttgctagtggtctatcaattttgtcgatcatttcaagaagccagctcctggattcattgattttttggaggtttttttttgtctctatctctttcagttctgccctgatcatagttatttcttgccttctgctagcttttgaatttgtttgctcttgcttctctagttcttttaattgtgatgttagggtgtcaattttagatatttcctgctttcttttgtgggcatttagtgccataaatttccctctacacactgctttaaatgtgtcctagagattctggtacattatgtctttgttctcattggcttcaaagacatatttatttctgccttcgtttccttatttgcccagtagtcatgcaggagcaggttgttcagtttccatgtagttgtgcagttttgagtgagtttcttaattctgagttctaatttgattgcactgtggtctgagagacagtttgttgtgatttctgttcttttacatttgctgaggagtgctttacttccaattatgtggtcaattttagaataagtgggatgtggtgctgagaagaatgtatattctgttgatttggggttgaaagttttgtaaatgtctattaggtcttaaacttaaagtataatttaaaaaaagaaagtaaaaagatgataatccacttcatgaaaacacacaaaattatataactcactcatagagccaacagacaaaggagaaagaaaaaagaatcaaactttatcagtatagaaaactaccaaactgtcaaaaataagtaataagagagaaattaaggaataagggttatacaaaataaacagaaaaaataaaagaataagcctttacctataaatacataaataaataccttgaaaataggtggattaaattatacaactcaaaacatagactaatggattaaaaaacaagacccaactatatacagcctaaaagaaactcatctcacctataaagttacacatagactgcaattgaaaagatgaaatagatatgctatgcaaacagaaacccaaatcaagcagaaatagcttcacttacataagcaaaacacaaactttaagccaaaactttaaggagaggaaaagagagacttaatatgataataaatgaatcaattgttcaaaaagacaaaaatgtaaatatatatgcaaacaaccatgaaccattgagatatatgaagcaaatattattatacctgaaaggagagatggacctaagttcaataatatttgaggatgtcaccaccaccttttcagcattggacagatatttagacaaaaaatcaatagaaacacatgagatttatactgtaccatagaccaaatcgaagtaattgacatttacagaacattttatccaacagctgcagaatataagattctttttatagcacatataacatccccagaattaaccatatatgaggacattaagcaagtctcaacaaattttaaaaaataaaaattttactaattattttatctgaacacaatgaaataaagtataaaatcaatgacaagacaaaactagaaaaatccatgaaaatttaacaacgtattccttataaccaataggtaaaaaaagaaacaattttaaaattacttaaaacaagaaaaattacatcatgcgatagcaaaatgtatgagattcaacagaagcactattaagagacaagtttagaacaagaaatgcctacatgaaagaagtagaaaagtttcaaataaacaacctaatgatctctctcaaagaactctaaaaataggaacaaaccaaaaccaaaattagtgtaagtaaagaaatactaaaaattagagagaaaaaatgaaattaagactaaaaaagatgaaacaaaatgctaacttttttaaaagacaaaatcagcaaggcattgactagactaataaagaaaaacaagaaaatatccaatttaataaaatcaaaaacagaacaggaaacttcacaactgatacagaaatacagcacatcattaaagattgtaatcagcaactacacaacaaatttgaaaacctggaagaaatggatacatttcttgacatatacattagactaagataaaaacaacaaaaaatataaatcttgcacagactaatactgaataacaacattaaatcagtaacaaaaagccctccaataaataaaagtccaggactacctggagtcacaactgtattctaccaactttaaattattatgctaactacagaaaccagttacaaaaaacacatcttgtgtgattccatttatatgaagccctcaaaattggaaaatgtatagagacagaaagtagattagaggttgtccagggttgagggataaggagatgctaaggatacgaggttagttaaggatgatgaaataatgtaaaattgaacatcacgatagtcacacaaattctgtgaaaatacaatgagccactgaattgtcttggctttaaattagtaaactgtattatatgtcaaatatatgtcaacaaaacttttacaaaacaaataaacaaacatcccttggaccatgatatctaagaaagtctgattcagctgtgtaagtactttaggcctacgccaagcagactgcagacacaaagcacctcttgctatccactgttcataacatgattctaaactttcttatatcacataggtgatttgtatttgcaagataatcagaacttaaatggggaaaagcatttgtaattgttaaaagagatattaaacacatcatataacacaaggtcatctagatttcactttttccacttgccatgaagatactctgaccattcaaataatgtacttacattgatatgtagtagttatattttaaattcttgacaatctcttctttaatataagcaagataaatggtacagggataaaatttgaaaggaagtaccgcatttaatcaggatgtctatgaaatgaatttcagctctactatagctactgctgagttttttcctcaactctggaagtcgtgaaaaggtgctgatgtagctatggaatacagtcattggatcgatttagaggcaaaactggatgaacttatccagatgaatcatgagatcattgtgagaccatcggcttccatttttcttgatctcagcaaaccatttgctattaccttggaatttaattctatatctttattgaaagaaaacttaaaggattattgtctcagttaataaatataattggtggaaagatatattttagacatttatttcattcatcaaaaaatattttgcaaatattttgtttattttaaaagctctgtcagatgttgttttacaaatagaaaagtatcgcaggcttatggattggaaaaataaatattgtgaaaatgaccatactgcccaaagcaatctacagattcaatgcaatttctattgaattatcaatgtcatttataagataattataaaatataattctaaagtttatatggaaccaaaaaaagaacccagattacaaaggaaatcctgagcaaaaggaacaaagctgatggcataacattacctatcttcaacatatactacaaaactgtagtaaccaaaacagcaaagtactggtataaaagtagacacatagaccaacagaacagaatagagaacccagaaataaagccaaatacttaaaaccaactgttcaacaaagcagacacaaacatgcacaaaggaaaggacactctattcaaaaaattgtgatagaaaaaaaggagagccacatgcagaagcgtgaaactggatgactatctctcatcatatgcaaaaattaactgaaggtggattaaagacttaaatgcagaagaaaatataagaaatactcttttggacattgacctacacaaagaatttatgactaaagacacaaaaagaaaagcaacaaaaccaaaataaagaaatgggactttaaaaagcttctgcacagcaaaagaaataatcaatagagtaaacagacaacgtacagaatgggagaaaatatttacaaactctatatctgacagaggattactaatcagaatcaacaagtaactcaaacaaatcagcaagaagaaacaatcttataaaaaatgggcaaatgacatgaatagacatttctcaaaagaagatatacaaatggtcagcaaatatggaaaaaagctgaacatcagtaaccatcagggaaatgcaaattaaaaccacaatgagatatcacctgactaatggtatactcttatcagaatgattgtattttaaaagtcaaaaaaagtagatattggcgcagatgtggtgaaatgggaacatttaaacactgttggtgggaacataaactagtacaacctctgtgaaaaactgcatggagatttctcaaataactaaaagtaggtaaaatatttgatccagtaatcttactaccagttacctacacaaaggaaaggaagtcattatattaaaaagacatctgcactcatatgtttattgcaacaaacttcacaattccaaagatatggaatcaacctaagtgcccatcgacagatgagtgaataaagaaaatgtgatctatatatcacatggatatacacggccacatctcacaggaaaaattccagatcatccatgggaacttccccttacctcagcgcctttggggactttgaccaaaactaggaaggctgcatcagtagggaaaagatgctttccttttcctgtgcttcagctccttgctgggagtctacatgggttttgtacacagtttccaggagggcaactcctagagtgcagtagcctgctgccactgcgaagccctgatcctgggcatctataagcagggcctcaactgccaagccagtggtatgagctgccaccagcagtgcaaggattgcctgtaagttgagcaccagtgcaggccccagagtgtgggcctggaggagtctccacgtcaccctcacacactcatacccaccatcatcccaccttcagcttctccctgccctgccatggcaaacgagactcccagcctccagagattcatgaggaggagatgcagatggtgaaggatggggtgtttgacaactgcttgtaattgatgctatgattggatcaaggactcattcctgccttggagaaaagacttgaaccagagcagggagcctgggggtgctgggacagaaggttggggctgagggcagaatgtgatggtggcatgcagctaagggcagggccagggcaggcgtccctaaggttgtaccaacttttgtgaatatttgtattttcctcatggaataaaaaggctcatgtaattaatctccatatatatatacatttatatatgtgtatatatacatttatatatatataaatgtatacacacacacacacacacacacagaaagagagtagtatatacatacacagcatacatgcatatatattcccttttttctgggagtttttccactcatttccattcaccaaagcaatgcctttgtgccatgtacgtgaagaaatattcgtctgctctagcaaagacctcatctggcacagaagctgtcagggaaacaactacttggttgaatttgcaggagggaaaaggggagacttctttgagatccctggtttttttaatgaagactttatatggcttaccctgtgagaaatgttaaatttctggacaatccttggctaaccagatctgtatattagtacgttccaagttgttcagcagaacagcagacaaattacttttatttttaatttcaatactctttgctttagaaacaattttgctgtggcacttcctagtctgtgactctgtcttgaaaagggctggaactcaggctgcgtagacatacatatttcatttatctggtcttcaacttaaacattcacctctttataaaaacttctctgtaattctgaaggtaattcccctttttttgatggagttcaaaaattgctgacttgcactgttgggaaatcatcactgactgtgatttcattttccatactttcatatttacatccacctgctttttctgttcagtgggagacaagcagttggagccaaccttctgagcttcttcaaaaaggctatcaacaaaatattcacaatttgttgattatcactgagagattgattgtcagatactgtttcacaaacccatcttcttttatactttcgagattatctacctctttcattctcttttgtcttattctgggcagggtctcctggcctcagcctcactcagctcagaggccacgagcaccctttggccccgggctccgtctggagcccgctgctccagacctccttaggttccgccgcggcacagctaggatcctgacggactctctaggtctctgccaggcaccagacaccaaaagcatgctgatgtagtctcaattgatttgtttttaaattggtaattaaacctccacctttattgaaagatcatttggaagattttgttctcatactcggtcagttaataaacatatgatttgtcaaaagatagattttagaaacattttatgaattcaaaaaatttgagggaaatatttgggttgttttagaagctctgtcaagatgtagttttaatcaagaaacttatgtcaaaagtttaagaatcaagccttaatattattcttgcagatgtccttggtaaaatctgctggtggggataattaaaatacacattgtatatactttgtatttcctttttggccttttttttttttttaatggagtctaactgtcacccaggctggagtgctagagtgcagtggcacaatcttggctcaccacaacctctgccttccagatggaagcaattctcgtgcctcagcctcctgagtagctgggactacaggtgtgccccaccacgcctggctaatttttttgtatttttattaaagatggggtttcaccatgttggccaggctggtcttgaactcctgacctcaggtgatctctctaccttggcctcccaaagtgctgggattacaggtatgagcccctgtgcccagcccagtgtggagcttctattcactcctttctatgtacctgtggttctgtcagaattaagtgatcaaataacataaatggagatggtaaaaaaatgtgataagacatcagaaagatagtgggatagaaagccagcaactcatgtctccccttgcaacaataagaatttttcacacaaccacagataaaagactctttagttttggtattcaggtaggatgttgtgaaacccctgtgtagcccaagacctagcaagggcattttgagaatacataacagaactcaggtattagactcacttataatgccagaaacagccccatttcccaaaaagcttgtctacagccctgtttggccttgagcctgtaatcaaaattatcttcccaggagtccaggaggaatcatactcactagtgccttagcagaaaagcttatctgtccaccaacattggtctcagcagcagaattgacagttatcctgtaactcaggggaaaccccttcagttgtggtgccagattattactgcttgggcaaggacatagaagcagatttacccatgtctttcagtccagtaattacctgttcatctgagtgtgtgacaggcctgtcaatcttcattcaaacacaaattatgaggaagcctagtttcagctctagcccttctggctgcagttggagaactatcctacccacataggaaagtgctgggggttgcttgtccacctgctaatgaggtcggctcaccatcctccttctgcagtaagtccctagggagcccagccccagctccaaccttcctttctgcagtcagggaccttccctgctcgtgcagaaaactattgggaagcacatttgcctgggccaccatccaggctcaccagtctctgctcccagagcatattctgggagtgggaagggcagtctcgactcaaacccctcttgctacattcaaagaactgcttctacttttcaagaaagacaaaagagacaagagacaaaagagcagaaggctattcaaagaaataatagcggaaaactttcataacttggagaagatataaacatccaggtagagttaggtaaaattaaccgataagatacaacataaataagattactctaatatatattataatcaaactctcaaaagtcaaagacaagctgctgaaagcagcaagataaaagaagtaaaatgcatgtaaaggaattacaagacatctggcaacagacttctctggagaaaccttgtcagccatgatagtgtcagacaatacattcagagtacctaaggcaaaacaaaacaaaacaaaacaaaacaaaacaaaacaaaacctgccaatcaaaaatactgcatccagtattagaaatgctatcctttagaaatgaagtagagataaagactttccagacagactgagtaaatctagcatcaccagacatgtcctacaagaaatacaaaaatgagttattcaaactgaaggaaaaagatgtttttgcataacaagaaatcatctgaagacagaaacttcactggaaaatgtaagtaggaaggcaaattcagaatactctaatactgtaattgtagtgtgtaaaccacttacatcttcagtataaatactaaaagacaaaacaataaaaagtaataataactacaaaaatttattaagagattggaaatataaaaaatgtaaattgtggcatcgaaaacttaaaatacaagggaatattacagttaaagtatacaggggttttttttgcttctctttcaaatcaaagataattgtattggtttaaaataactttttataagatatttttctctccattccaagatggctgaacaggaacagccccggtctgcaactcacagcatgatggatgcagaagataggtgatttctgcatttccaatggaggtacctcgttaatctctttgggactggatggacagtgggtgcagcccacggagggtgagctgaagtgtaaggggtcagggtgtttccctttcctagcaagggaagctgtgacagactgtacctggaaaaatggggcactcctgcccaaatattgcacttttcccagggtcttagcaactggcagacaaggagattctctcccgtgcctgacttgggggggtcccatgcccatggagccttgctctctgctagcacagcagtctgagatcaaattgtgaggcaacagcctggctgcaggaggggtatccatcattgctgaggcttgagtaggtaaacaaagcagccgagaagcttgaactgggtggagtgcatggaagttcagcaagccctactgcctctagactccacctctgtggacaggacatagctgaacaaaaggcagcagacaacttctgcagacttaaacgtccctgtctgagagctctggagagagcagtagttctcccagcacggagtttgagctctgagaacagacagactgccttctcaagtgggtccctgatccctgtgtagcctaactgagagacatctcccagtaggggccaacagacacctcatgtaggtgggtgtgcctctggtacgaagcttctagacgaaggatcgggcagcaatatttgccgttctgcaatatttgctgttctgcagcctccactggtgatacccaggcaaacggggtctggagtggacctccagcaaactccaacaaacctgcagctgagggacctgtctgttagaaggaaagccaacaaacagaaaggaatagcatcaacatcaacaaagaggacctccacaccaaaaccccatctgtaggtcaccaacatcaaagaccaaaggtagataaaaccacaaagatggggaaaaaccagagcagaaaagctgaaaattctaaaaatcagaatgctacttctcctcaaaagtatcacagctcctcaccagcaacagaacaaagctggacagagaatgactttgacgagttgatagaagtaggcttcagaaggtcgttaataacaaacttctctaagctaaaggagcatgttcaaacccattgcaaggaagctaaaaaccttgaaaaaaaggttagacaaatggatagttagaataaacagtgtagagaagaccttaaatgacctgatggagctgaaaaccatggcacgagaacttcgtgatgcatgcacaaggttcaatagctgaatcaatcaagtggaagaaagggtatcaatgactgaagatcaaatttatgaaataattgtgagaagacaaggtaagagaaaaaagaagaaaaagaaatgaacaaagcctgcaagaaatacaggattgtgtgaagaggccaaatatacattagattggtgtacctgaaagtgatagggagaatggaaccaagttggaaaacactcttcagtttattatccaggagaacttccccaacctagcaaggcaggccaacattcaaattcaagaagtacagagaacaccataaagataatcctcgagaagagcaaacccaaggcacataattgtcaggttcaccaaggttgaaatgcaggaaaaaatgttaagggcagccagagagaaagatcgggttacccacaaagggaagcccatcagactaacagcagctctctcagcagaaactctacaagccagaagagggtgggggtcaatattcaacattcttaaagaaaagaattttcaacccagaatttcatatccagccaaactaagcttcataagtgaaggagaaataaaatcctttacagacaagcaaatactgagagatcttgtcaccaccagaactgccttaaaagagctcctgaaggaagcactaaatatggaaaggaacaactggtactagccactgcaaaaacatgccaaattgtaaagaccattgatgttaggaagaaactgcatcaactaacaggcaaaataaccagctaacatcacaatgacaggatcaaattcacacataacaatattaaccttaaaggtaaattggctaaatgccccagttaaaagacaaagaccggcaaattgaatagagtccagacccatcagtgtgctatattcaggagacccatctcacgtgcagagacacacataggctcaaataaagggttggaggaagatctaacaaccaaacggaaaacaaaaaaaagcaggggttgtaatcctagtctctgataaaacagactttaaatcaacaaagatcaggagacaaagaaagccattacataatgataaagggatcaattcaacaagaagagataactattctaaatatatatgcactgaatacaggagcacccagattcataaggcaagtccttggagacctacaaagagacttaggctcccacacgatagtaaagggagactttaacaccccactgtcaatattagacacatccatgaaacagaaggttaacaaggatatccaggacttgaactcagctctgcaacgagcagacctaatagacatctacagaactctccacccaaaagtcaacagaatatgcattcttcttggaaccacatcacacttgttccaaaactgaccacatagttggaagtaaagccctccacaacaaatgtaaaagaacagaaataacaacaaactgtctctcagaccacagtacactgaaattagaactcaggattaagaaactcactcaaaaccacacaactacatggaaactcaacaacctgctcctgcatgactactgtgtaaataacaaaatgcaggcagaagtaaagatgttctttgacaccaatgagaacaaagacacaatataccataatctctgggacacctttaaagcagtgtgtagaaggaaatttatagtactaaatgcccacaaaagaaagcaagaaaaatctaaaatcaacaccctaacatcacaattaaaagaactagagaagcaagagtaaacacattcaaaagctagcagaaggcaagcaatacctaagattagaacagaactgaaggagatagagacacacaaaaaaacccttcaaaaaaatcaatgaatccaggagctggttttttgaaaagatcaacagcaagtattgtagaacagcaaacattgctgcctgatccttcctctggaagcttcatctcagaggggcacctggctgcatgaggtgtcagttggcccctactcagaagtgtctcccagttaggctacccaggggccagagacccacttgaggaggcagtctgtccatttcagagctcaaacaccatggtgggagaaccactgctctcttcagagctgtcagacagggatgtttaagtctgcagaagcttctgctgccttttgttcagctatgccctgccagcaaaggtggagtctacagaggtaggcaggcctccttgagctgtggtgggctccacccagttcaagcgtcctggctgctttgtttacctactcaagcctcagcaatggcgaatgcccctcccccagccagtctgcctccttgcagttggatcttggactgctgtgctagcagtgagcaaggctccatgggcatgggacccactgagccaggcatgggatgtaatctcctgggtgtgtcatttgctgagaccattggaaaagtgcagtattaaggtgggagtgtcctgattttcctggtagagtctgtcatggcttcccctggctaggaaagggaaatcccccaaccccttgcacctccggggtgaggcgatgccccgcccagcttcagcctgccttccgtgggctgcacccactgtccaaccagtcccagtgagatgaaccaggtacctcagttgaaaatgcagaaatcacccatcttctgcattgatcatgctgggagctgcagaccagagccgttcctgttcagccatcttggttcatcactatagacacgttacaaaggaagatatacaagcagccaacaagcatatgaacaaaaaggtcaatatcactgatcattagggaaatgcaaattgtaaccacagtgagataccactgatcattagataaatgcaaatcaaaaccacagtgagatactatttcacacaagtaagagtggctataattagtcaaaaaatagcagatactggtgaggttgcagagcaaagggaacatttatacactgttggtggaagtataaattagttcaaccattgtggaaagaggtgtggtgattactcaaaaagctaaaagcagaactaccatttgacccagcagtcctattactggatatatgcccaaaggaatatgtatcattctaccataaagacacatgtacatttatgttcattgcagcactgttcacaataggaaagatatggaatcacctaaatgcccatcagtggtagactggataaagaatatatggtacatatacaccatggaatactatgcagccataaaaaagactgagatcatgtactttgcaggcacatggatggagctggagaccatcatccttagcaaactaacacaggaacagaaaaccaaatgctgcatgtactcacttatgaggaggagctaactgatgagaacacatggatgcaaagagacaacagacactggggtctacttgagggtggagggttggggagaagaataggatcagaaaaaataactattgggtcctaggctttgtacctgggtgatgaagtagtctgcacagcaaactcccgtgacaggagatcagctatattagaagcctgcacttttacccctgaacctaaactataagttaaaaaaaaaaaacttaataaagaaacgtaaagtcaaaagttttgtgactattatgtcaaaattatgtgcttatcattttgctgctattccttttttaaaaaatgcatttttttctctctctgtaaaataatggtgttccctttccaatgcaaacatactttcagatcctaatcattggggtaaacattctttttaaaactactgtttacaaaagtaaaaatctgactttgtccatgcagatcatctattgacaagtatttttcaacagcataattttaaccttaagacatcagttttaatagcagtcattacattattattccaggtgattcatgggacacctgagcactctgtataattgaagttatctgtagccacatttaatatgacatgttcaatgtttggtctcacaagctcactgcttagagtcttcttcatccacccaatattgaagtaatgaaatggctgttaatagattcatcactgatctcattctgtgacatctttatcagaataatataaaatcaatgtaagaaattttgtgaaattatgaaaatttagaaaaaaataaatttcatttataaaatctgtgtgctttcattatggttttattctatttatataactcaatgtacatatattatgtttatataaaatctttttatctcattgcatatgtcttttcttccgacacaaaaattgtgatatttttctgttcatcattatgttgcatagtattcaacaatacctgtactatggctgacagtgtaatttaacattttttgataaaacaattgtaatggcatggtacacacattgtatacattttaaatcatttctcaatgtaaaatatttgaattgtctccagtgtttattttatgaatgtctgccacaaatattgaatctgaccatcgtgatttagttgttctctgtatagtttcatatgagtatattatgaagccaatgtctatgtgcatttttataatacttaatacttttccccaagtgtctgattcttttaaaatatgcaaacattatctgagaatctaatgcataatggaaaagcaagcaaatttgtgacaacaattattttatgtaagaaggaattagaggacaggctgcacaactattgacttggattggaacctaccttctgcaaatgaataacaacagctagtattagtatttatcaccattgtactaatagtcattcttgcccttgtcttccttctccacctactctcttcccccttctaatggcaccatcactttcctctattgcgaaaggggaaattttttgagaataaggttagagtgcatagaattttcattggtcctacctctgcctttgtcctttgggaaattaccacatagagcctatgcaattttcattcagcataaacattgggatttaactcgactaagatttcagttttctgttgttgctaataagaaggtagacaaaaagatctcttaagacttatataataaagtagtgaggaatgcttgctttctacttatgtctcaaaagaataacattaaagtaaaatatatgaggttcttttgtttcttcataaggaagatcatcctatatcctggcataattctttgataaatctcagtgtagttttcagatgcaagtggtagacattatttggatcttattatacatgcattgttcattttttttttggtgcttctctgtcaggcagctgtgatgatgagtcccaagtttcccagagatttttactgaggtgtcctataggcgtggcataaggcagaaaacattaaaagggtaaactgacccttttatgctctaagatataaacctctgtgatctcactgacgaaagttttaaatgctagagtgaaagcaagtaaacattggctttggctgagaatattctggtggcacacatttatgtcgttgatgaatagtgtaccttgaaaagccttaacccttacatcgttagcatttcatcttgttcatctgactgcccaaaaatctatatttaaacaagtccacaggggatctgttctctaggactttgctggagaaccttgatgtgttggaaaactgttcctattaatagaaaaattatatctcgagtggctggcatatgttaactaatggatactattaatagtaataacaaaaataaaaaatcattacaatattactactatttgaatcactatgtacgagagacattataagtgttttatctgtattaagtatattttcaacacaacacaataggaagaaattgccattattatagaagtaggcataattatctctatcaacattctagtccacttttccattatctgttgcataaactcatgcaaaatcttctaaatgatctacacttttcacaatctggcctttttgtgatgtaatccattgacaacattgagagctttttaaagaaagggaatctgatcacatctctccatttcttaactctgtgcagtagctccccattgcccttaatagacacttcgatctccttataattatattgcttccacttacctctctagcaacatctgctactttactcagctttttcctgcatactaattagaaatcttaggaactgcctttacttcactacctgcttttctttttttgttttcctctccccctcttcttttcacctattcctgcacattactgaggactcactttaccaatgactttgagatctcttctagatgtttgcttagcattgtgaccttataacacttttagacttttcctttttacttgcttatagtctatctttcaaagtacaacgtaaggcatgagggagcagaaagtgcctacatttcttctctgaaaatcgagcacttatccatggtttatgctgatcacttcataaacattctttgaaggaatgacttatactttttttttactttgcacaatgaaggctttcattgaatcaaccctgttttcagagtctctttagtatccctctttgatatttaatgacactaaagtttacacagttgtgatgatatagaaacatatgagtttctaatggtaggtcgctttactcgacctcccatattttctcttactgtgagtcaaacactctgaataaaaacatatctggccattccttctgaaatgcaaagcaaacaaatcaaacaggagtaaatttaccttaggcagggttttggctggtttacagtggagttcccccacaaaatcgacatttggtaagggtgggtgaagaaattcaaaatcccagtacagttgaatgagccacacttcagctttccccattgtctgaaataatgtacattaataaaataaatgtatacatatctttttatacataagcataacaattttcatatattgcatgttacttatatataaggaaagcaaagtgttcagataattaagaggaaattacatatttaatgtaacataagtatattcacaatcacaaatagttattgaaataagccactatggacttaaatatgcatttgtttcctctctaaagttgcagtagtaaccaatatagatttaaacagctctttgagctccacgattaattcatcttactatacttataaaaacagctttctacaaagcacaaaatctagtttccacaatttatcaagtcagtcccttgatccttggttctccaagtgaactgtgagttttctgagagtatggctgaaatccttgaacatactactgcttctagttcatgttaagattttaatgatattagttgtaaaatacatacatttaaaaatgatagctagtatatattcagaatttattgaaacagagatatgtgctcccccttaacttggcccatattttccctaataaagagaagtagttcaataaaatatagattaaaagcttgaatgttcactttcaacaaggtttcagttcacaaagcaaataatttccaagttgttagtgaactatgaacaaacactagaaacctcaaattttaggtttctgtttctgaaatagagccagtatacctctcaactgtgaaggaatccttctgtttatagagaaaaatattttaatacctaaataagaaaactgaggtacacaaagagaaacaagtttctcaatgctgcattaatagttatgctagaaatatgtgtagctcctcatctaaatgtctgccttcatcaagttgtttattgatatatgtattgccttttttaaagatgaaaaaagtatagtaaaatacttatatagttgcttaaagaaatcataagtgctttactttgtagttttttttttttaattcctgtagtgtcctataggagcgatggccaaagggttctagctgagcctataatatcaacatttctataatatttgtgagattgatagatcatcttacatttgccattcatcatttcatttaaacaacactatcttcttacattatatttatatacgctcaccttcaaaggcaaaaggaaagttagaacttattaaccattgattagaaacatgacttacctagaacttcactgtaaaacttctcccacttctcgtatcaaacatttgaaaccaaaagtcaaaataaagcacatgtattaaatttttaatcctctccacgaatgtcattttaccacttaattcagacagaacagcaggtatgcgggaagtggggaatagaagtcctccactatacttctcaagtgtgtagccaggagactgtcaacaaaggacatgtatttaacatgcctttaacatgctcagctagcagttcaccacaggcaccaagggcatctgcaagaacgacatcaaactttgactcttgtagttttgtcgtaattttcttgttcaaaactacatctttacagagattattaacacagtctgtagattcccaaaagagttcttgtgcttgtgagaaatatgaccaaaatgcatctttctgaagatcgtatatccatctattgatcagtttcacaacaagaccctcaaaattatttttaattagagatgttggataaacctcaaatctaatagcagatgatttactagggtgaataataatggaagccaaagatgacagcacagtcatcttatggcctctccaaacaagttcatccaggattgtctttatattcatccaatggctgtattctgtgggccacactagcacctttccacaactcccagaactaaagtgacaactgagttgtatcaggagaatatttgacatcgatttcatagttctcctggtgcaatgcaatgcttcttttcaaatcgctgtttctttctgtttttctcctacttatatctgaagataaatcaatcaagtgaaagtataactgctacaattcaaagtagtagttaccatataatttctaaattaccataggaattgtctgttaccatataatttctaaattaccataggaatttccagattgtttttcacagtggatgcttcaatttccattctcaccagcaatgtataagaattttaatttcttcccaaccttgccaacacttgggattatatttcgtttgattatagccagtgtgaatgaagtgatatctggttatgctttacctttctttgatatgaaatcatgttgagcatgttttgcctaattttggttgaattatttgtcttcttatggacttgtgtttttaatatctttctgatataagaaccttatcacatatatgatttccttgttttttttttattctttgggctgtccttttactttcttaacggtgttcattgaagcacaaaagtattgattttgatgaagtccaactaatcaattttaatttggttgcttttatttttgattttatatctcacaaaccatttccaagttacaaaaattagtacctgttatttattattagagttttatagttctagtgcttacatttaagtttttgatcacctttgaattagcttttgtaagtgatttgaggtagagggtcccaactcaattattttgtatatggataatcattattcccacttatatttgttgaataatctattctttcccccttaaatagttttgaaacttttgtcaaaaactttaaatgcatgggtgtatttctatattctaaaatccattccattgatctacatgtctatctgtaggcctgtatcacactctcttgattattgtatatttgtatttgtctttaaaagcaggaaatgtaagttttccagctcatttttattttaaattgtttcagttttttaaaaaatttttttcttcttgctttttttctttaagaggtagaggtgttactatattgcccagactagattcaaatttctgggctcaagcaatcctcccaacacagcctcttgagtagctggatttacagatgtgtttcactacacctagcttcttttggctattagtatgtctcttgaatatgtataaatttcagaatcagcttgtctgtttatgcaaagaagtgatctgggattttgatagggattgcattgatttggtatatgaatttggggagtagagtatggtaattatcacaatattaggtctttcaataaatgaagatgtgatgcctttctatttatttagatgttcttatttccacagcgttttgtagattttgttacagtggctagctagtcagacacaaacagggcagaagacggctcccacaccctaccaggaaagtcagatgaccatcagttaatggtcaggcagttgtcacactgtctcgctaaaataataattggttgcagccagccagagaaaggcagctttcctataaatagaaaaaatcaaatctggtaatcagcagcttcctgataagatctcaggagttgggtgagtgggctcacgcatgcacattaagaggccaaatggtggagtaagacattccggtggcaccagaaaagggaagaatgcctcaggggagcattcatatgactccagtaaacatactgtgcatactcatctcctaagtgctagcaggccatcacacataccagcaggtcaccctaaggaaagaatcaaggaaaatggaagcaggatcctggaagtatgccaacatataaaaccctaagtcaaaggtcaaacactgcactttaccttcaaaatggccacttggatataccccaagtgtactttcctttctttcctgctataaacctttttaataaattttcacttttgttctgaaacttgtcccggtctctttttttgccttgtgcccctcaatcaaattctttcttctgaggaggcaagaattcaggttgctgcagaaccacaaaaatttgctgcagtaaccaccactagtaataatttcacagtgagagttgtacaattttttgttaaacttattactaagaattatattttttcatggtattataagggtgattgtttaatcttcattttagtttaaatttccattgcaattttgtagattttttgttttcttatcttggatcccaaaatcttgttttattggtttacttgaatattttttagtggatttgtaaaaatttcctattacaagatcattatatatgccaatagagatagtttaacttctttctttctaatgtggattccttttatttcattttctttcttatttgttgactgaaatttctactgcaatattgagtggaagtgagaagagtcaatttagtgtgatgttagctgtgtatttttttttttttttttttttttgagacggagtctcgctctgtcgcccaggccggactgcggactgcagtggcgcaatctcggctcactgcaagctccgcttcccgggttcacgccattttcctgcctcagcctcccgagtagcagctgtgtatttttttatagatactattgatcagttttaagatgttctcctttacttctagtttaagtgttcttatgatgaagagtattgaatttcattaaataagtttttctgcagttattgaagtgattatgcagttttttcctttattctaatgatatgatatactagttggctttttcagatgttaacataactttgcattcctggaataaaattcatttgtttatggcatttaagcttttcgtatgttcctgaattttctttgctagtgcgaaaggaaagtaaaaatcttgagacattaaactcactatgtcaaagagaaaagttaatcttgggaaacaaaccatgtaaaactggctcccattttgttcctaaacagataaatgcaaaaatagaaggccacatacctctccagagggcctccttcccaatttactcacaaggaaaatcacaaggtcctaaaacagagttctcttgacttttaccctgagagtataaattaacattttatatttgcaggtatataaaagacaggacttgaagccattgtgtggtttttagcataagggcttactgaatggtggttatgttttctcctcttttattttttggaggattaattattttaaatatttgatagaagtatagagctttgatattttctactctaccatttccagttattaccccactatttttttctaaataatatttcactggaagccatcagacactggcttttcttttatgggagactttttccttacagcttcaatcttgttacttgttattagtttgttcaggttttttatttcttcatgggtctatcttggttggttgtatgtgtccaggaatttattaatatcatctaggttttccaatttgttggtatatagttgttcataatattctgtaataatttgtgtttctgtaatctcagttttttgtctcctctttcacttctgattttatttagtgggtctgttctcactttttccaacttagtctagctaacagtttgttgattttgtttacttttacagagtttaccttattgtctgtggctgcttttgtactacagtggaagagttgagtaggaacaagagtctaaagggtttgcaaattccaaaaatatttaccatctgaggctttatagaacctattctgatctctgcaggttcattttttcctttaacctttctatatattcaatatatatttctatatatttctgtattactatatattcaatatattgtatatattcaatgcaattttaataaaatagtatagatttttagtgagtcagatgatttatgtttaattatgttaataatgagttaataaattaatttgtatttccattttatttagaataggtgagtttgtttgttatgtggaatggtgcttctgttttaccttttttttgagaaatctctaaactgctttccacagtaattcaactaatttgcaatccaccaacagtatataagcatttccttttctctggatcctcactagcatgtggtattattattaatttatactttttagtaatagccattatgactagtgtgagatggtctcattgtggttttgatttgcatttctatgatgattagtgatgttgagcatttttgtcacgtttgttggttccttgtatgtcttcttttgagaagtacctgttcacatcttttgcccggtttttcacggggttacttgatttttgcttgttgaattattcaagtttcttatagattctagatattagacctttaacagatgtgtagtttgctaatatttcttcagtttacatctcacttgtgaattttgagttttgttgcaattgttattaaggacttagttataaattctttcccaaggctgatgtctagaatggtatttcctagattttcttcaataagtcttatagctttaggtcttatatttaaacatttaattcatcttgggttaatttttgcttggtgaaaagtagagatccagtttcattctttttcttatggctagcaagctatcccaccatcatttattgaatagggagtccttttctccattgcttatttttgttgactcagtgatagatgactataggtctgttgctgtatttctgggctctgtattctgtttcattgatttatgtgtctgtttttgtaacagaaccatgctgttttggtgtctgcagccttataacatagtttgaagttgggtaatgtgatgcctctggctttgttctctttgctgaggcattcttcagctatttgggctaatttttggttttatggaaatttttgaatatttttttctaattctgtgaataatgacattggcattttaataggaatagcatttaatgtgtggatggctttggttaggatggttattttaatgatattgattcttccaaccctgagcataaaatgctctaccatttgtttgagtcatctatgatttatttcagcagtgctttgtagttcttgtagaaaacttttgtctccttggttagatgtatttttaagtatattttgtttgtgtgtgtggtataaatgtgattgtgttcttgatttgactcttagcctgaatttttattggtgtatagaaatggtattgatttttgtacatggattttgtatcttgaaacattactgaagtcatttttcagttctagcaggctttaggcagtctttaggattttctaggtatagaatcatatcatcaccaaagaacaataccttcaattcttttcctatttggatgccttttatagctttctcttgcttaggtgctcaattaatacattattgaaatagaaagtgctgtcattttaatcatttatatttgaaatataaaattttaaaaatttatatttgaaattttaatcatttatatttgaaacataaaattttaaaattttaaaattttaaaagatttggactatgttaagtccaaattcattgcagaaatgtacttatccatttaataataataatagttatagcaaattgaattttgctatatacagcaattacatacagcaactcttttagtctcagcaatgctattaagtaggtagtgacattgcttcatctacatttcactgaaggagaatgtgaggcatagacctgataagtaatttgcttaaccataagtgattctgtaatggttttgcaaagatgatataggttatctggattcagagtgcaagctcttacccaccatcctatgctgactactctttctgggttacaggtagttacaaaatgtaatatagattcactttttttgtaggtatatattaattttaatattattacaggagtataactcaaatatgtaaaaatatttttctggttgtctatcactgcttaaccaactgctctgaaatgaaggtgcttagaacagcaacattttatcatcatctgttttaattctaggttgttggccaggctcagttaggtgtttatggcacagcatttctcagttggttactgtcctaaggtagcttgggctaatcatctgaaggttaatcactcacatatctggtgattagtattaaaagtctcaagctactgcagtgctgggccaattgtgacttattaggcatacatatgtatttctacaccaaatggtatatttctcctggggactgtggatatagcacagggctccaaagcgagtggagagacagagaaaaaggaaaaaagaatgacagaaacacagagaaaaggacagaaggacagacagagaaaatgtattaacaatttttttgagctttggaagttaagctcctcacttccactatattctcttttttgagacagccacaaaatttgctaaatttcacaggaagggtatatgacttgatgagaggattgccaatgcatttgtaatcacatctcaaaattactgcgaatataaccttaaaaattagaagaaatcactaaactactgtagaattcataaaatgttgacataagacattaaaattttaaaaatttgtttgctaaaattttagccataattaaaaattttaattaacattctaatatatttattaataaatatttaaaatatcaagtaggtgtccaaaaacaggctgtaaatttatcagatagagagcaccggattgctggtcaatttaagttttctaaatggcactaatggattgataatattatattaaaacccaagaacatgctatctcaaatcaatgtttatttcactaattaatttttaaaactatataattaatatataaaaacaaatttgtgaaaggttagtgaatgaagtatatagaatcaaaattaaaagtagaatcctctatgtttatacagatttacagattcttaattttatttcaaagaagaatatcatacttttttttctgaaactttttttcatttagcaatgtgatgtggagagcattccatgatattgtctgtaatatgcctgttctctgtaattgctgcataccttctactttttgtggtaggtatgtatgttcattgactgatagccaggcaagtgatggagggaacatcctgtacatacatgcactcaggtgcaagtatatctggatggcagatgactagatgtagaattgcagagtcaaactgtatgtttaattttttttgtaagagttgtttcactttatactctctcacaaactcttttctcagattcttatgtttgatcaatctcctgtgggaaaataattcgttgactttttatggctacatagtaatccatggtgtatacatactgcactttccttattcagtctaccattgatggacatttaggttgatttcatgtctttgctattgtgaatagtgttgcaatcaacatatacatgcatgtgtctttataatagaatgattatattcctttgggtatatacccagcaatggcattgctgggtcaaatggtatttctgtcattaggtcttggaacagacaaccaaatgctgcatgttctcacttacaagtggaagctaaatgatgagaacacatggccacacaggaagctaagtgatgagagcacatggaacacatgaacaacacacactggggcctcttggagggtagaaggtgggaggggggagaggatcaggaaaaataattagtgggtactaggcttaatacctgggtgttgacacatatttacctatgtaacaaacttgcacatgtacccctgagcttaaaataaaagttaaaataaattcattgacttaaggttattgacttactaaattataatgtccaactttctagtacaagtagccatctttttgatgtgattggccatttttacttctgtgaattgtcaattcatatccttcatctattttcatattggtctgtttgtctttttggttggtgatatataatagctctcactatacaagagataccagtcctttatctatgtgttgcaggataagcttgatgtaaattactttaggtttgtatgcatgatttagcaatattatctactatgacactatattcattcaatttttcttaaaaatgtttcatttatctagatacattttataaaaatgttgctgcaatctcttccaataattcccttagcatcaaaattttaatttatttttagaatacattcatgccataggtcatagagtggttattgtgagacttggatgatggtcttcttaccaataaagacacataggtttgtgttaacccatactactttgatcataaagtgtttccttgatgtgtagcttttaagagggccttgagaattcctgagattttattatttgccaatttttggtaatttttgtggtcttttaattgttactgattatgattagttgcaatatgcttacattttaaaaaatcattatcctatttttggtcatgctaaatgacttatgttttcatattagtgttatgggatgaatagagttacaggcttctgaggaaagagagaaacatgagacatccttatataaaatagggttatatagaataattatcatttttaactgtcttctacaaacacattcagtttcacaaacatctgtaaggcagctcaataattctgtgccttgttttggaagaagtgaacacatatatacatgtacatttgtgataatcaaaatcagtaagtccccttaaagtgctggttttatattatcacaacctacaattcagacattttatccaatattaaagtttaaaaatgaccgtgaaagcaaccagttcacactttagaaaagttcatggggaaaagagaattagcttgtgaacaaaggttttcccaaatagttaaattttgtagtatttgtcaggtaggagtcattctatctctaatttgttgttctccaactccaagtctctgagtcccattattttgctcttcaggccctgaatttggcataaagtgtagtagaggcggacagtgtcgtctcctgtgcatcactgttgttttgcgaagaaattctcaatgtggtcagctgctgctgctacagaagtcgattttctttaaacactgccaagaacatctgacttacatagtatattttgatttgatatttattcaaactgagcctgctttttttctttttacaaactctctaaaactgctaaaagtcttcactttataaactatgtaattaccatgatctttatactgttggtaaagcaatggttcactttccccatgtctttcacctcagttcttttctcccctgtgtgaattgtatccattttgttcaaagtgattttactgaataccaggagttatcacctctcaagtgttattggcaatgagattgtttttgccagttatcagtgaattattaaattccaaagtcccttgttgagggtctgctttttagtgccacttgcccaagctgccatagtctatttttctcagaaagcaaagcctgagataagaattagtgtgcaataacttaatttgagaaatgttcttagggtacaggagtaggggacaggaaagggtgaaacaagaagggagaaaagtcagtacaagaatgtgttaccaaactaatcatcaccataactgttgggactaaagctcatgcggacccagtaggaagttgtgtggatgtaaagcgtgatcattaaccatcactttctattgctcacactgccaggttatgcatatgtgagtgagtgctagctgagtttcttcgagggttccatgaagagatgttaaagaagtctggtgcagaaaatgagagacctgtcctatcagaagacgacttcacaaagctccttgacacagcaaaggctagagaaaaaaaaattagctgaaaaaatatggggtgcaacctaatttgatcaaatgtattagagctttcttttttcttttgtttcattttcacagtatattacttttcatatgattaaatactgtaaattttctcaggtttctgataaagttatgcctgtgatacaggagctagaaagaaattatttaggcagatagtgagggtgaaagtccttggtaaggttttgttttaataaaaagcagccccccaaatcatttccttgctaacaaaaagcagccagaaaaatcaagcttcaaacctagataaacaagctaaagcttgcataggtaaatgctggcaactgtgccagtaattcctcaaggatctagaactagaaataccatttgacccagcaatcccattacttggtacacgcccaaaggattctaaatcattctattataaagacacatgcacacgtatgtttattgcagcactattcgcagtagcaaagacttggaaccaacccaaatatccatcaatgttagactggataaagaaaatgtggcacatatacaccatggaatactacacagccataaaaaaggtaagttcatgtcctttgcagggacatggatgaagctggaaaccatcattttcagcaaactaacacaagaacagaacaccaaacaccacttgttctcactcataagtgggagttgaacagtgagatcacatggacacagggaggggaacatcacacactggggcctgttgaggtgtggtggactaggggagggataggattaggagaaatatctaatggaggtgacgggttgatgggtgcagcaaaccactgtttcacatgtatacccatgtaacaaaactgcagattctgcacatgtaccccagaacttaaagtataattaaaaaaaaaaaagaaagaaaagggatgggataccttgaagccaggtatattcaacatggatattcaacgtggaggtcccctctttccttttctttgtcaaccatatgtgcagtaaagaagcagcaacatggcactggccatgtagagaaaccatttgcttattgaaaattaaggtggggcagacagcttcttcttacactatgtaaatggcacacctggttccaccaatcctttgtgccctatataaatcagacactgtttcctcaagctcatctataaatccctgtgcatttcaccatgggactagaagatccattcgggagcacctttctgcagaaatgagagctattctcctttctctttctttcccctattaaacctccattcttaaactcacttctcgtgtgtccatgttttcagtttccctggagtgagatgatgagttttgagtatttaccccagacaatgatgctgcttaacctgttacttttatttattcttatttttaaaatttttatttattttttatttattttactttaagttctgtgatacatttacagaacgtgcaggtttgtggcataggtattcatgtgccattgtgatttgctgcacccatcgacctatcatctaggttttaagccctgcatgcattaggtatttgtcctaatgctttctgtccccttgtcccagaccccctgacaggccctgatatgtgattttcccctctctgtgtctatgtgttctcattgttcaactcccactaatgagcgagaacatgtagtgtttggttttctgttcctatgttagtttgctgagaatgatggtttctatccatatccctgcaaaggacatgaactcattttttatggctgcatagtattccatggtgtataggtacacattttatttattcggcctatcattggtaggcatttgggttgtttccaagtctttgctattgtaaatagggctgcaataaacatacatgtgcatgtgtctttatattacaatgatttttaatcctttgggtatatatccagtaatgggattgctgggtcaaatggtatttctgcttctagatccttgagcaattgccaaaatgtcttccacaatggttgaactaatttgcactgccatcaacagtgtaaaagtgttcctatttctccaaatcctctccagcatctgttgtttcttgactttttaatgattgtcattctaattggcatgagaaggtatctcattgtggatttaatttgtatttctctaatgaccagtgatgatgagctttttttcatatgtttgttggccacgtaaatgtattcttttgagaagagtctgtttatagcctttgcccactttttgatggtgttgtttttgtcttatatatttaagttccttgtagattctagatattagacctttgtcagagggatagattgcaaaaaattcctccattctgtaggttgcctgttccctctgatgatagtttattttgctgtgcagaagctctttagtttaattagatctcatttgtcaattttggcttttgctgcaattgcttttggtgttttagtcctgaagtcttcgcctatccctatgtcttggtattgcctaggttttcttctagggttcttatggttttgggttttacatgtaagtctttaatccatcttgagttaatttttgtataaggtgtaagaaaggggatcagtttctgttttctgcatatagctagcaagttttcccagttttcccgttgcttgtttttgtcagttttgtcaaagatcagattgttgtagatgtgtggtgttatttctgaagcctctgttctgttccattggtctatatatctgtcttggtaccagtaccatgctgtttttgttactgtagctttgtagtacagtttgaagtcaggtagagtgatgcctccagccgcttttttttgttttgttttgttttgttttgcttggggttgccttggctatacaagctcttttttccttccatataaaatgtaaagtagtttttctagttgtgagaagaaagtcaatggtagcttgatttgaatagcattgaatctataaattacgttaagcaccgtggccattttcatgatattgattcttcctagctgtgagtatggaatattttttcatttgtttgtgtcctctcttatttccttgggcagtggtttatagttctccttgaagaaatccttcacgtctctttttagccatattcctaggtactttattctctttgtagtgcttgtgaatggaagttcaatcatgatttggctctcagtttgtctattatcagtgtataggaatacttgtgatttttgcccattgattttgtatttggagactttgctgaagttgcttatcagcttatgaaatttttgggctgagatgatggggttttccaaatatagaatcatgtcatttgcaaacagagacaacttgacgtcctctctttctatttccataccctttatttctttctcttgctgattgccctggctagaacttccaatacaatgttgaaaaggagtagtgagagagggcatccttgtcttgtgccggttttgaaagggaatgcttccagcttttttgcattcagtatgatatgggctatggatttgtcataaattgctcttattattttgagatatgttccatcaatacctagtgaatggggagtttttagcatgaaggtgtgttgaatttatcgaaggccttttctgcatctattgagataatcatgtggtatttgtgattggttctttttatgtgatggattatgttcattgagttctgtatgttgagccaggcttgcatcacggggatgaagctgacttgattgtggtggataagatttttgatgtgttgttagattcggtttgccagtattttattgaagatttttggatcaatgtccatcagggatattggcctgaaattttcttttttgttgtgtctctgccaggctttggtatcagcatgatgctggcctcataaaatgagttagggagaattccctctttttctgttgtttggaatagtttcagaaggaatggtaccagctcctctttgtacctctggtagaattcagctgtgaatccatctggtcctggactttttttggttggtaagctattgattattgccacaatttcagatcctgttattggtctattaagagattcaacttcttcctggtttaatcttgggagagtgtatgtgttgaggaattcatccatttcatctagattttctagattatttacatagacatgtttatagtattctctgatggtagtttgtatttctgtgggattggtggtgatatcctctttctcattttttatttcatctatttgattcttctctcttttcttctttattagtcttgttagccgtcgatcaattttgttgatcttttcaaaaaaacagctcctggattcattaattttttgaagggctttttgtgtctctatttcgttcagttctgctctgatcgtagttatttcttgccttctgttagcttttgaatgtgtttgctcttgcttttctagttcttttagttgttgtgttagggtgtcaattttagatctttcctgctttctcttgtgggcatttagtgctataaatttccctctacacactgctttgaatgtgtcccagagattcttgtatgttgtgtctttgttctcattggtttcaaagaacatcttgatttctgccttcatttcattatttacccagtagtcattcaggagcaggttgtttagtttacatgtagttgagtggttttgagtgagtttcttaatcctgagttctagtttgattgcactgtggtctgagagactgtttattataatttctgttcttttacatttgctgaggagagctttacttccaagtatgtggtcaattttgtaataggtgtggtgtggtgctgaaaagaatgtatattctgttgatttggggtggagagttctgtagatgtctattacgtccgcttggtgcagagctgagttcaattcctggatatccttgttaactttctgtctcgttgatctgtctaatgttgacagtggtgtgttaacgtctcccattattattgtgtgggagtctaagtctctttgtaggtctctaaggacttgctttgtgaatctgggtgctcttgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggcagatcttcctccatccttttattttgagcctatgtgtgtctctgcatgtgagatgggttttctgaatacagaacactgatgggtcttgactctttatccaatttgccagtctgtgtcttttaattggagtatttagtccatttacatttaaagttaatattgttatgtgtgaatttgatcctgtcattatgatattagctggttactttgctcattatttgatgcagtttcttcctagtcttgatgggctttacattttggcatgattttggagtggctggtaccggttgttcctttccatgtttagtgcttccttcaggagctcttttagggcaggcctggtgatgacaaaatctctgagcatttgcttgtctgtaaaggattttttttctccttcacttatgaagcttagtttggctggatatgaaattctgggttgaaaattcttttctttaagaatgttgaatattggcccccactctcttctggcttgtagagtttctgctgagagagctgctgttagtctgatgggcttctctttgtgggtaacccgacctttctctctggctgcccttaacatcttttccttcatttcaactttggtgaatctgataattatgtgtcttggaggtgctcttctcgaggagtatctttgtggcattcgctgtatttcctgaatctgaatgttggcctgccttgctaggttggggaagttctcctggataatatcctgcagagtgttttccaacttggttccattctccctgtcactttcaggtacactaatcagacgtagatttggtcttttcacatagtcccatatttcttggaggctttgttcatttccttttatacttttttctctaaacttcccttctcacttcgtttcattcatttgaccttccatcactgataccctttcttccagttgatcacatcggctcctgaggcttctgcattcttcacgtagttctcgagccttggctttcagctccatcagctcctttaagcacttctctgtattggttattctagttacacattcgtctaaatttttttcaaagttttcaacttctttgcctttggtttgaatttcctcttgtagcttggagtagtttgatcgtctgaagccttcttctctcaactcatcaaagtcattctccgtccagctttgttccattgctggtgaggaactgtgttcctttggaggagaagaggtgctctgctttttagagtttccagtttttctgctctgttttccccccatctttgtggttttaactacttttggtctttgatgatggtgatgtacagatgggtttttggtgtggatgtcctttctgtttgttagttttccttctaacagacaggactctctgctgcaggtctgttggaatttgctagaggtccactccagaccctgtttgcctgggtatcagcagtggtggctgcagaacagcagattttcgtgaaccgcgaatgctgctgtctgatcattcctctggaagttttgtctcagaggagttcccggccgtgtgaggtgtcagttctcccctactggggggtgcctcccagttaggctgctcaggggtcaggggtcagggacccacttgaggaggcagtctgcccattctcagatctccagctgcgtgctgggagaaccacttctctcttcaaagctgtcagacagggacatttaagtctgcagaggttactgctgtctctttgtttgtctgtgtcctgcccccagaggtggggccttcagaggcaggtaggccttcttgagctctggtgggctccacccagttcgagcttcctggctgctttgtttacctaagcaagcctgggcaatggcaagtgcccctcccccagccttgttgccatcttgcagtttgatctcagagtgctgtgctagcaatcagtgagactctgtgggtgtaggaccctccaagccacgtgcgggatataatctcctggtgcaccgttttttaagcccattggaaaagtgcagtattcaggtgggagtgacccaattttccaggtgccatctgtcacccctttctttgactaggaaagggaactccctgaccccttgcacttcctcagtgaggcaatgccttgccctgcttcagcttacacacagtgtgctgcacccactgtcctgtgcccactgtctgtcactccttagtgagatgaacccggtacctcagatggaaatgcagaaatcacccgtcttctgtgtcactcacgctgggagctgtagactggagctgttcctatttggtcatcttggctcctcctcctaattcttgaagatttcattggctaaagtaaaacaaaaattctgctcaaaatgaagccaaaatattttgagtatttgcaaaacaatgttgatactatgagtggagttcttaatgttgttgtgttcaaatacaatgtgtgaaacataatgaagctcagtaactttcgtgtgtaacttttggattagaataataaatatcaatataagcccataaggttttatattatttttatttttcttttcttttttttttatggcttggatgacactttattttcagatccaatactagaagttgtttccatgttcacattttccttcctggtttaaaaaaaagagttgtattttttttttttgctttttttaaattatactttaagttttagggtacatgtgcacaacgtgcaggttagctacatatgtatacatgtgccatgttggcgtgctgcatccagtaactcgtcatttaacattaggtatatctccaaatgctatccttccccccattgtatttttcatagcttaaaaatcattgacatagaataattcagctaaagtacgtattaaatccctggaaaataaattttgtcttaacaaggtaagttgtgaaaagatgttttgtcacaggaaaaaggaaatcctccatttaaaaccctccatgctgaaataaaggaggagtcccatctttcagtcattccacttcaggcttttgatataactaatctcttttcttcttctttccttttttggcaagctttcggaaacaaaacaggcaaaattttgtgatgataaatatcacagttgccacgcaggccagcaggaatgctatcacatccaaagagtggtactggatccaggtgaggttgtgagctgcgactcgaaggtgcttggctcctttgtggcgcatgacaaactcaatccagaagactgctcgatccaggggcttcattggttggtcatgatgaattcttgataatttcatgacattctctttatagctgaaggataaatataaagatatcaacattaaaagtaaatttattgcttaagcatatcaagtctatggatggtctttgaaaagtgtcacacaaatgattgaaagtaagtgtcactgaattggcatgaaatttcaatgttttaattcatgtcattacagaaagtttggtttttaaattggagttttatcactgacaaatacctttaaaaatgaaaaatggaattttcggtgggaaagttaatgttttctggagcagaaaatattatgagccattctaagtgctataagtaagatagtggaaatggaatttgagaatgatctttttgatctttttaatttttttttattttttgagacaggcttttgctccattacacaggctgagtgcagtcacatgatcatggctcagttcagcctttctctttcggtctcaagtaatcctacatctcagtctcatgagaagctaggactacaactgcacaccaccatgcctggctatatttttttattttttacacttttagatatgaggtgttgctgtagtgcccatactggtctggaactcctgtagtcaagtcattctcctgcctctgcctcccaaagtgttggccctacagacatgaaccactgtgcccagcccattttgacgtatttaaagaagaattgtgacacaactggtgaaatgcctcctaactagtttctcagcttctactctaatcttttgtcttctaccatattttccttctagtagccagaatattttccaaattaatatcaaattatgacactcacctgttaagatttccatctggtttcttgttacattaagaataaattccaaatctgtctttggtctagagaactctacacaggcacctacttgtcctagccctttccccctgtacactttcttctagagacaatggccttcggtttttctctaaactcctgaaggtgttctcaccttagcccctttacaccttttgttccccgtgtctctctcattgagcattctttcttgcaactacttgaggtttgcttctatttctttttgaggcttccccttgtatgatacctcttggagagtcttttcctggccacactataggcacccataggatttctctagtgcttcatgcttactttgctatttgatttctggaactttaaaatatgttgtatatcttctacagtaaaacttcaagtatgaaatacataggataaatgtatatatactatgtgactacctcaaaattttaagattatcttaaacattatcccaaagtgaagacaccaatttatcacaaactgcatagaagaactctctcctcctgggccattttagtcactatttttatcctcaaagtaagtattaacctgatttctgatatcatagattagtattgtttatataattgaattaaataatacatattcatttctgtttttggttagcagttgtttaatagcattggtgtagagagtattcagttgattgacaaagaccacagatgatctcttcattttgtgattaatggatatttgtgttgttaacattttttgaccttactaataattatggtattaagatatttgtatattttattaggtttaaatatttattcatttttgttggatgtatacttggaagaatagttgatgagagaaaggcacatttataattagaattttttgttgactgaattttttaaaaaatattttttattttaaagaatcagattgttttcagttatcgtttttggatgatttataatttatttctagtatgactagaacatataatttttatgaatttgaatctgatacaatttacttagtgtttatttatggcccagcatatggtaaattcaggtaactatttcatataatctttttttttttttttttttttttttgagacagagtctctctgtcacccaggcttgagtgcaatggagtgatcttggctgactgcaatttgcatctcctgggttcaagtgattctcatgcctcaatctcccaagtatctgggactacaggtgctcatcccctacatctggctaagttttgtattattagtggacacaggatttcaccatgttggccaggctggtctcttaactcctgacctcatgtgatcctcccactttggcttcccaaagtgtcgggattacaggtgtgagccaccacacccggtctccataaactcttttaaaaatgtttattttctgtctacacacacacaaccagagatatatgtatggatacatatatacagataaatgtgcaatatatatacacacacacatatataacacatagattacatttaattgtgtacttcaaatgttttatctccttaaataaaatatttcaaagatcactattttgtcttttctttttggtctgcttaaatttaatgtgagtactggtaggttcacttttttgtttttttgcttttttgtttttttttgagatggagtctcgctctgtcaccaggagttcagtggcactatctcggctcactgcaacctccgtctcccgggttcaagtgattctcctgcctcaacctcctgagtagctgggactataggtgcacaccaccatgcccagataatttttgtatttttagtagagacagggtttcactatgttggccaggagtatggtctcgatatcttgacctcgtgatctgccctcctcagcctcccaaagtgctgggattacgggcgtgagtcactgcacctggtcagttcaaatttttttaaaaagttttatttttactttaagttccagtatacatgtgcagaatgtgcaggtttgttacatacgtatatacgtgccatggtggtttgcagcaccgatcaacctgtcatctagattttaagcccctcatgtattagctatttgtcctgatactctcactccccttccatcccccggtgtgtgttgttcccctccctgagtccatgtattctcattgttcaactccctcttataagtgagaacatgtggtgtttggttttctgttcctgtgttagttgctgcggataatggctttgcatttcatccgtgtccctgcaacagacatgatctcattcctttttatggtgcatagtattccatagtgtacatgtatcatattttctttatccagtctatcactgatgagcatttgggttggttccatatctttgatattgtagatagcgctgcaatagacatacatgtgcatgtgtctttatagtagaatgatttatatgcctttgggtatatacgaagtaatgagattgctaggtcaaatggtgtttctggttctaggtctttgaggaatcaccacactgttttccatgatggttgaactaacttacattcccgtcaaaaatgtaaaaagctttcctatttctccccagcttcaccaggatctgttgttttttgactttttaatcatcgccattctgactggcatgagattgtatctcattgtggttttgatttgcatttctctaatgatcagtgatattgagcttttttcataagtgtgttggctgcataaatgtctttttttaagaagtgtctgtttatatcttttgcccactttttgatggtgttgtttttttttttttttttgtaaatttgtttaactttcttgtagattccggatattagacctttgtcagagggatagattgcaaaaatcttccctcattctgtaggttgcctgttccctctgacgatagtttattttgctgtgcagaagctctttagtttgatttgaccccatttgtcaattttggcttttgttgcaattgcttttggtgtttgtgtcatgaaatttttgcccatgcctatgtcctgaatgatattgcctaggttttctcctagagtttttatggttttgggttttacatttaagtctttaatccatcttgagttaatttttgtataaggtgtaaggcaggggactagtttccgttttctgcgtatggctagccggtttctccagcaccatttatttaatagggaatcctttccccattgcttgtttttgtatggtttgtcaaagatcagatggttgtagatgtgtggtgtttttctgaggcctctgttctgttccactggtctatatgtctgtctttgttccagtactatgctggtttggttactgtaaggtgtaaggaagggatccagtggcagttttctccatatggctagccagtttttccaaaacatttcttaaataaggaatcctttccccagttgcttgtttttgtcaggtttgttaacaatcagagggttgtagatgtgtagtgttatttctgaggcctatgttctgttccattggtctatatatctgtttggtaccagtaccattctgttttggttatgtagccttgtagtacagtttgaagtcaggtagcatgatgcctccagctttgttctttttgcttaggattgccttggttatatgggctcttttttgtttccatatgaaatttaaagtagtttttttctaattctgtgaggaatgtcaatggtagtttgatgggaatagctttgaatatataaaatactttgggcagcatggccatttttacaatattgattctttttatccatgaggatggaatgtttttccatttgtttgtgtcctgtcttaattccttcagcagtggtttctagtcctccctgaagaggtccttcacatcccttgttaggcatatgcctaggtattttattctctttgttgcaattgtgaatgggaatttattcatgatttggctctctgtcaaatcatgtactgtcagtgtatagtaatgcttgtgatttttgcatattgatttttgtatccagaggctttgctgaagttgcttatcagcttaaggaattttggagctgcgacaaaggggttttctaactatagaattatgtcatctgcaaacagagacaatttaacttcttcccttcctatttgaataccctttatttctttctctagttcacatttaaatccagcatcttattctatatatatatatattttaattttctaacctgttttatgtttctttactttcttactttttttgaagtatcttaaatcatttcttgtcttactaattttttggtaaagtgtttttaatgtattcccttagctggtaccacctaacctcataataatattggtaggagtaatagactctgaattgatggtagctggtctaggcacagcatttttcatagtatttcctttggattatggaaaagttaagtattacatatttattttatcaacattgaaacctttgtatttcaaaaggcatcttccaaaaagtaaaaaaaaaaatctatctgtccatagtggaagaaaatatttgaaaatcacatatttgataagggattgtatctataatatataaataattcttatgaatccataagataaatagaaaaagacaaaatattcacaagattaaaatagaaatttatctaaggaagatgtgtgaatgaccagtaagcacatgaaaagagggttaacatcttcagccataaggaaatgcaaatgaaaaccataatgagagaccactttacacacactagaatggctgtaatagaaagacaggtgataacaagtgttgggaagagtgtgaagaaattagagccctcctatccagctggtggtaatgaaaaatgatgcaaatactttgaaaaacagtttagcagttcttcataaacaacaatttcccatatgtctcagcaagtccactcctagcatctcctcaaaagaagtaaaaacatatttttacacggaaaatatgtataacaatgttcataaatgccaaaattggaaagacctaaaatgtccatgacctgataaatgggtaattttggtataaacatatcaaagaatattatatagaaataaaaatgaatgagttctgatacatcctacaacataaataaaactaaaactaattatgctaagtgaaagaagtcatttatgaaacaccataaattgtatgatttcatttatataaaatatgtgaagagaataatctattgagaaacaaagtaagatggtatttttctaggactagaggtttattgggagtgacttcatacattatgagtttaatttgaattcattaaaatgttctttagggctgtggctttgtaactatgtaaacatactaaatatatttagattttaaattttagtgaatgttatgctatgcaaattataattcattatcacatttcttaaaataatgataataaaaataaatttttgagaaagaatagattcatactttcagaaattttaggtattgaattgaaatatcatatttctctagttatgttctttcttttcattgtgcattctatcattaaaaatatttaaaataattatctacatatctttaatttttttgattttataattcattgcagtcattggtgacccattaaatctgtggggttgaaatgtaactttgaaataaactgtctggtggaaagtaaggacagattttacattggttaaatcacttcaatcccttcaaaattagtctcttaaaaacgggttaaaattcatattcactgttgacaaaataatttataaataccacctggtcacaaaactgtaatactcacacagggtcattaatgactgacttcaatgcattgagcaaatctctacttgacatggtcctgatgtccacactgagggctgctcccttggctttcatgtgagcaatgttatcatgttgatccgcaaacaagggaatgcccaccatagggatcccatggtagatcgcctcatagatgccattggttccaccatgagttataaaagctttggttttgggatgacctaaaagtggatgcattttaacaaaattattaattacaaggtatgagaattgaataagaaatgcacaatataaggaacttaaagcaaaactgttccctaggtaacattatacccacaaaactgcattgaaattgttttcaaatttcagaagaattgccaggtgaacaaaatgaaaaagcatattcttaattaaaaaattaaaatgtgcaaaaaaaagaataagattgggtatacaagaacgtggtcttttaagtattataaataatgaggtcacatttacatatttaaaaaatatttaaatacttaaaatatttaaaatatttaattttttttaaaaggcagcagggagtagggtggaggtggggctgaggaaggaccggttatgcatcatcatgaaatgtgttatcattttatcatgataaagattggttatttattcccataaaaagtagagtcactggtaatagaaaagtgtccgctatttttcagtgcctgttgaaataaccctgcagtaggggaaagaacagaggtaaagctgcataaataggagacagacagaaaatccaggatgttatttaaaacctgtgagaggaaattacacctgaacaaagagatttttattctgaccataaagaatgtgactgtatgtaataaaatgccaactactatagtgcattctttttatactaagactggaaaataaatataaagtagttaaatttgatttgttttttagttttccaataataaatgctaaatatgtttgttttatgttgaactattatcactccaatttgctgttactaatatattcactgtttgttctccagaatcttaccaagaaggtcattctggggtaaccacttgtacagtcgagtattggaacctaaagtatttggcttcttgccatcaaatctccatagaacctgttagggcaaggaaaatatcttgttcaatgaatagaactctaaaaacatagcatgttagaattctgaagagattaataatcagttagttaatccatataaaagatgaagaaataagaagaagtgatgtcaagtaatgagaactactaaaagtttgaggtaagttgaatacccacgtttaatgtcgttacttttataatcaattttgtatataaagaaataatgacatttctaacataatagctagacacatgagattgtgaaaggaaaataaatcttggcaacccaaactctatgctaaagggaaaagttaagctgcttagggcaaacctacctcccattctattcaaagtcagcccttgactcactgagataaatgaatatcaaattgcctcatttcgagaggctaatcagaaactcaaaggaattcagctatttgtctctcatctacctatgacctggaagccccttccatgcttcaagttgctctgcctttgtttctagctgtctcccatttctggaccgaacaaatgttcatcttatatatgttgattgatgtctcatgtatccctaaaatgtataaaaccaaactgtccccccaccaccttggacacatgtcatcaggacctcctgaggctgtgtcatgggtgcacattttcaaccttggcaaaataaactttctaaattatctgagaactgtctcatatattcagggttcatattttggtaaccatgaagagattctgagtggaggttccctgacctttgataaatgtcctatcagtgcttggtaccagcatgagctaaatttatggctcaaacaaagaagacaattggctgaggtctgggagcaacccctccagagaatctctgataccccaaaattcagacaagatctgaagtttattttgctgtacaactcctttttgttttttttggagttttacttgcttcctacaagaaaggcaagatttcctgtttccatgacaatggaaggcaggtaactctatggagtttgagctcgctcccaggagggaggatgaatttgaggtttctttcctgattctaggatggcagagggcagttttggcctgaaacccatccgtaggtaaacagctgaattgcggttttgtcttggttaatgtttaacaactagctggacttaatttctccttaccattacagtgcttagtgatcacatttctgggatttttttttttttttgtacattccagtatttctcccatcagatttgatgaactttacctgacttgatcaaatctgagtgagaattccaaattgtgggtaacaaagcctgtctaatttggctaaaattctttgcagacgcaaaagagaaaacaaaacaaaacaaaacaaaacctaaaaaccatgctcttggtttctgtgtttgcttcctgtctttaaaaaaacaaatgttcttttgtttacttttcctccaccctatacctccttttgccttttgccatttgcagtatgaaaaatctagagaaggcttctaatgacttgaactcttttaaagaattcagaacaaaggcaccactcacccctttaggggtgtctgttttctttgtggagttccaagagttgtgggcagatttttttctcagtccaaagctctgttttcctatgttgaatgacctgatctctttggctttgagattaccacagattaccttgtactgtgagaggattttaccttggcatgtgtaatggcagacgagttacaaagtagggggtggctgagtacagtttactggaagtagtattgactgttgctatttttttcctcctaggaagttgttgtttaagaatcctaattctagtttggagatgtgttgtaaagggtctcctctattgtttttattccccaaattaatctcatttggcttgtctgtgtggatttgtgtgagaaactgaactgtggtttacataggaaaatgagagactgagttttctcagctccaaagtgaaagggcatctgctcctcccaggcaaaaggcacccctaagcaactgggggccttgtgggagtgtcttggggttgaccccctgtgacatggagtggccctgcagggaaatccccaataaaaattaacttttaaaaaaaggctagtccaggaaacacatatgagggcagatcacccagcattttgagccctctcagaggtcatacacctctggagagagaaactgagacatgtaagagggtggaaacaactcagtggtgacacactgtggagtactgcccacaagcagcacacattgattcaccacacataaaccctaggccacagctcagttcctccttttaggaaaaaaagtgggaaacaaataatctaagaatgatgagaaaacaagaagaatgaccccctgatatcacttggtaggttttatgacacctctacttggcagagtttatgtaaaatgaaggtaatacggtctttgtgcacatatacattaagaaccctaggttgtcctgcaagctatagagttcctaagttctctctttttaaaaaaaattcttttcttcttgctttaaatttgcttttatttttctattaagataaaaaccacactatggattcaacaggtttttgtctgcaagctggtcaattttttttatctcatggctaaagttctgaagtaaaagccatagaatcttttgtgtgtgtgtacatgtgtttgcatatatttaaaaggccattataatttctataattttatgtttaataggcaattgaatccattttattttccttccagcacaccaaattttttgtctctgtaccttatgatgtaaattttgctatttaattttcacttggtttcttttaatatgcaaatgtaagactatttagcttacaactgcctatggtgatcaagtattcatacagattacctattgaaacaggttatcaagaatttggaagtctaatatggcaaaatgtagttttcataaatctataagatgtacttctattggcatgcttaatgtgtgtatgtatttatgtgttttgtacacagtgttttattactgaaaatatataaaagagctctaattaattggcttaagaaaataaaagtgcttgaattaaatactttgccagaaaaaaaagactagtcaaatgctttttcaagtttatgtaacttcaataaaatcttttataaataagataactttacaattattgctaaagtatgataatattagaaatgtcttaagaatttccagcatatatttttgtttgcatttattaatcaagcaatttcatacttattgttgccaaatactttaaggtgtcaaaatttgacataagggttacaaaactgtaaaccaagcccaaaacagaatgatctttgcttgtgtaattttttaataaataagacattgatattggtttaatgaaaatagccacatcttgaattaagtaagattatcataacttctaaccctgtggccttaagcaatctagtccacaggcagtaaggtttgttttgggaaaaaactgttatcatttttatttcaaagctaaaccataaagggtgtgaaatggcaacactatccttcaactcattttcaactcatataagtttttttcctcaagttctgtttgttgtggcataatgctaacagtgctttctaaaagctattcagctcctcaaggtccagggactatcacagaagaggtgggtgtgtgagattttaagaactgatactgagagataagttagtttatttacaaattaatcattaatgtcaaagacacactaatgcaagaccaacatatgggcccctgtgtcagattaacaaggttttctggaagcataaactgacttcttaataaagattataaaggttatgaaaggctgaggaaagttatatcttatggtcaagattagaattttatagattgttcataaaattttgaaaaacaaagttatttggcttcatgctattttattagggcttattgtttggcaaattgagtctcctctctcaaagaatgaagatttttgcctttttttgaaatccttgagttaccacattagtcaaatgaatgatttatcttacctgtgatattaagtgttttaaacctttgatatttgagaaattttccaaacaaattataaattatgattttttctgacctaagtaatcctttaatttattagtttccctaacatccaaaaatgacataatttggtttattttgtataaaaattatacaggaaacattgtcaaatatgaaatggtgtttggtctttttgagctgtatttatataagtatgttattgttatgtgttccaaaattatgggaaactcctataattctgatatgacttagtgtgtacgttatcagtaacaattatatgtgttaagttattgtgtgccacagaggtaacaaatttccttgtccattgtgtctttgactgagtctgccctaaaactttttgtcctccacagacaattgttgtcttactttggtcctctttagaaggcgattttatactcagccataaaattctaacaggtgctcttgaaaaaaagtttttgataattttggagattgtgacattagaatggaagaaaaactttcaggactcatggagaactaaaatgttcatgagtatcaagcagaacaggaattaactacatggactgaaataataaaaaactaaagtaatcttttagactttgcttaaaacattgctgatcctttgttttgtttttttttcagagtgaaggaatctttttttttttgagctattaacagcttttaacaatttagtatactcctatgaaaaaaatttagaacgtatttgtttccctctacctgatttttcagaatttggaaactatttgtgagtattttttacttttgtcaatacagttatttgcataagtgcaataagaatctattttcatttttaacaaaacacaattggagaaactggttattttatcaaggcttccactggtatggtgggctttcctttagggaatcaaacttaacttatggagccaataaaaccccttgggaaaactggcctcataccttcatctataaggtccctgtacagggttcctgaactgtgttaagcaaagaatgtaactttctgacaggcccaggagccccaagtttattttggaaccccaagaggagaggaattcacccaactcgtaggtatttgatggtagaaatctatggctttcctcagctttaaaaaagtcctatctgagattctttctataagacaaagttccatcaaagccactttaaaagcctatgtaaataaaaaattattcttcctcctctgtatacaataatcaggccaagtataataaagcaaatcagttgtaccatggtttgtctttagtaaaattgggaaactgaagacagaaaaattatgtttcaaaaataacagtatacctgttgttagattctagtcttgcctaatgtttttcaacttttattactgtctacagtttggactgaattctaatttttcatggcgacacgtcttcaaaatagtgtcttcaggttttttttcctccctttccaccatttttcctagtttggagtcactgtaaactaagtcatgctttcatgaagccctacaaattaagctagacaacttaaactccagaagaaaataacagcaaccaatttacatacataatccactttcatacctgcctactgatttatggacttcagagtaatgggcctatattaattttcaaggatttttcttttgtttggttttgtttttctccctttctccctttattttgtcttcataggacatgagacttcacaacctactaaaaatgaactttcctaataactcaggacctgcttaggaataaaccttccttgccattagagatcagatgaaaacctgagaccagagactcattttcttctaaaatgctttctccaaaagattttttttaaatgtaaaaggaaaataagcctgggggccccaaagtcactaagcaaatcactgcctcccattctattcaaagtcacccctctgctcactgggataaatgcatatctgattgcctccttggagaggctaatcagaaagtcaaaggaatgcctcctccctgcttcaagttggcaaaaataaactttctaaatgtactgagacctgtatcagatatttggggttcacaagattatcaatgaaatattcaaatatttaagaattgttaagcagtcttaattctagtaataaaaaagtagcaaattagtaataacctatatatttattttatatactttatactagctgtaaccttccaaatttaatataaatttattaatttttgagtgatatgagaagagtttacttatatccacttgtctactagtcataagttattttatgaatttgacatcattgattacaaaagactaaatatttaaactgcacatatggtgagaaataatgctacatatgtagtatgtgtaatttcttttcatttgctaactatcaagtgctactttcaggaaaaatttcaagtggcagtgtttgacacaaattcagactattatcagtattgctacttttgtaaatgctaacaatgtaggaaaaaggagcccattgacaattcatgattaacaatacagatgctgaaaatgtagaaaattgtattttgctgcattttgcttaactgatctttcacacttagatgatgcactacctagcattgacagccttgatatatggtcagctatagccagtcattaccatgtctagtaccaaactaaggtactgattttagaattcccaagcaatctttataaactggagtagaatttacaagtgttgaccttgtatttgatatgggagtgttaaagtaactctgtgttttcagcaaaaacttgtatagatcattcagagagggctatgtcagataagaaactaaaacgtaaattgaaaatacacaaagattgtatagattagaaaataagttcctaccatgtttatttatattttctgctccttcctcaatctggagaaggcactaatctgattcttagagcatagtctttgttgggccacatttaataatgcacatagtctaccctaaaagcaggattctatctccatcctttccattacatttttctgcttaagacattagcggcacccaagtcagcagagcagacaagttttttttttttttctctaaatctacttggctaggtgggtacctccagagcagtggctagtcagactaggacattctttctctgaatggcaccctgaacagaacactaaatagacctattccaatacatgggaagtaaaaacagccagattgcttggtaagacgaagctgcatgatgcatttcaaagttttttcgatacctgcttattgttattgtgatagtacagtaacttattaaaatttaactgctttttgataatatctacagtgtatacagtaccttctaaaatcctgtaaaccaaaaggagcaaatgacagggcagaatttagtgatttctatgtacatgctacgataccatgataataccaaacttcactagcacctcttaaatatatttccttctgatcacaatattaatgccaacgttattatcaaccaaaactcctctctttatgattttaagatcttccatatatgtttttgttttgaacagatgtctgagataattagaactatcatagcagttaaattttcaggcagaacatttctgtaatggactcttgaagagtttaacagattcatttagtagccatccacagttaaggcactttatctaaccttttgtgggatctgggcaagggctgatgcaatcatgttggcactttcttctgacatgttactgatcatcgaccccagagaaaacaccacaataccattttctccagagctctgcacaaactcttccatttcctgtgaagaaagaatttgttctatcagaaaagagcaacagcacagaaaacactattgacaggattgttacaaacatctaagatgagaaagtcagaagctattggagtaatttttttaaactgacctaatcattcagtttctttgaaaggagatgtgtaatataatatatgtgggatctttcatgcaaatttgtgtaaatatgtgtgcatatgcatgtatgtatgtgtgtgtaaggaggaaatgaaacaaagctatgacactgcagtaggaggagataatgctagaaaatgttacacccagacactttatttataatattataattactaacataggttattggaaggtagctttacttggcttcaattctaattttttttgtggttctactaaatctcttgtgtttatttggggtagttttattttattttatttttttctgttcagttcttttagttaggagtcattggagccattacatgactatgagcattgaggaaaagttagttacaattggaatgatattatatctacatttatttagcttctagctctctaaccctttatatttcacttaaagttagggtttcctagtcttaccccactacccctcactgcccccgacacccccaccccccaaaaacaccttaaaagctgaagtataagaatcactgacattcagcagtctggtattgtggtttggaatttctgggaaatagttctgagaattccatttataatacagtattatatactatatagttacataattaagtgatcttatttctcaggtcattgcttaggtatgactatgacaccttttgtcctgaaatcacactgtgaatttgatgtgctatgtataactgaatgtgggggaccctcatcatcactttgctgtgtctcacagggggcacttgaaccacagtgggagaggtcaccaggactttctccagtggagatctgctcaccccctagagtagctccctcacactatatgaagctcctggtgaatatgtgtttgctttgaaatgaatgagaattattctgacttgtgtttcctgatgtgtccctgtttttaaacttaaatccattctctaatgccacatcgctcaatgtattctcacaccaaaaaaaaaaaaagagagagagaaagaggaaaagaaatgtagacccataagtttcctggatatcatatcaaaattgtatactcatctttttgttgctgttgtcccttttgttcaaaattctctttttctcagtaaaataatgaccaaccccttctgtcataacaaatatactttctggtcctaatcattgggggaaatttctttataaaactgtttacaaataaaaaaagaaattctaaaatatgtcaattcagaccatatattggtaagtatttttaaaaaatataatttaactttatgacatcttttttttttttccagatggagtctttctctgtcacccaggctggagtgcaatgatgcaatcttggctcattgcaacctctgcctcccaggttaaagcaattctcctgcctcagtctcctgagtagctgggattacaggcacctgccaccacgcctggctaatttttctgtttttagtagagacaggtttcaccatcttggccagactggtcttgacctcctgaccttgtgatccacccgcctcagcctcccgatgtgctgggattacaggcatgagccactgtgcctggcctgacatcagttttaattggagattcagtgtatggctattagagataattcatgaggcatccaggaactcagtgtaattgcagttgcctgtagccacatttaatgtaacttgagttcaatgttttgtctcattcactgccaaaagtctgcttcacccacccagtattgaagtaataaaacatctatttatagacagatcagcactgatctcattctgtgatgtctttatgaaagtaatggtaatagaagatcaatgtaagtagttttataaaagtatgaaaatttagaaaaagaaaatcatttacccatatctctatctcaatttaaaatgtgtgccatttcattatgggtttaattctatttatataactcaatgtacatatgtgatgtttatttagaaaattttattctcattgtatatgcctttttattctacaaaaaaactgtgatcttgttctactcatcattttgttccttagtttccaactatacctgtaccacggctgacagtgtaattaaacattgttttgaaaaaaggattgtaatggcttggtatgcacattatgtaagtttttaaccatttcttaatgtaagatatttgaattatttccagagtttttttaatgagtatttgctaccgatattgaatcttaccatcatgatttattctctgtacagtttcatgtgagtatattataaaggcaatgcctatatgcatttttcaaacacttgatactttttggcaagagtcttattcttttgaaatatacaaacattatctgagaatctaatacataatggaaaagcaagcaaatttgtcgcaacaattattttgtgtacaaaagaattagagaatcagtttcacaattatttacttggattcaagtctaccttctgcaagttaacaacaacggaggctcacacttgtaatcccagcactttgggaggctgaggcatgtggatcacctgaggtcaggagttcaagaccagcctggccaacatggtgaaactctgtctctactaaaaacacaaagattagtcagatgtgttggcaggtgcctgtaatcccagctactcgggaggctgaggcaggagaatcagatcgcttgaacctggggggtggaggtttcagtgagccgagatcatgctagtatcagtaataatcactattgtactactagtcatttatcccttgtccttattctgctactctcttccccctgctactggcactatcactttcttttaatgtgagtgaggaatttttttttgagaataagataagagtacacagaattaccttttaagctagaatattaatgaagagcctccacctttacaatacaactttagctttccagcttgttcaactgactgcccaaacttaaacatttacatttaaacaagtacacagagtatctgttctctaggactttgctagagaatataatcttgatgtgttggaaaatcaatcactattaaatgaagactgatatcttaaatggctggcacatgttagctaatttaaagtattaaaaataatgactgaaataatcataatatcaacaatatttttggatcactggctgtgtgtcagagacaacttaagtgttttatctgtggtaactactttttttccacacagcacaatatgaagttgtgattattattataaaagtagtcatgattgcttaaactcatgtaaaagttcctaaatgatctttacattttacaaacttgcctttttgcaatattatacattgggaatattgggattttttaaaaggaaatctgatcatatctcttcatttcttaactcttttcactcttttcagtagctctccattgtccctatgggtatatcaaattacatatatatatatatatatattttttttttttgagacagattctcactctgttgcccaggctggagtgcaatagcgtgatctcggctctctgcaacctctgcctccggggttcaagtgattctcctgcctcagcttcccaagtagctgctattacagtcacctgccaacatgcctggctaacttttgtatttttagtagagacggggtttcaccatgctggccactctggtctccaactcctgacctcaggtgatccacctgccttggcctcccaaagtgctgggattacaggtgtaagccaccacgcccggcccatcattgacttttactcaaccttttcctgtaaattaaatttggagttcctgggaactgcccttattgcttttctacttttctgccttaatgcaagcctttactttttttttttttgtttatttgtttgtttttgagacagagtctcgctctgtcgcacaggctagagttcagtggtgtggtctcagctcactgcagcctctgctcccagactcaagcaagcctcctgcctcagcctcttaagtagctacgactatgagactacaggcacacaccagcatgcctggctattattttattttttatttttgttagagatgaggttttaccacgtttcccaggctggtctcaaactcctgagcccaagcaatcatgccttctctgcctcccaaagtgcagggattataggtgtgagccaccttgcctggcctctggttttctttttgggtgtttatcaacccctcatcgtttcacctatctctgcacattattgagtactcactttaattgtcaatgagtttgggatctcttctgcatatttctttatcattgtggtctttccttataacactttttagacttttctttttcacttgtttttattctatctttcaaagtacaatgtaaggcatgagggagcagaaactgtgctacctttattctctgaaaatccagcacttacctgtggtttgtattaatcactctacaaatattttttgaagaaatgaatcatactatcttttgggtggcacaatgaaggccttactttaaccaaccctgttttcaaaatctccctagtaaacctctttggtctttaatgataataacattcacatacttgtgatactacagaaatatatgattttctaatggcaagtccttgtttttgacctcccatattcccctcactctgagttaaacactctgaaagaaacatatccagccattccttctgaaaatgtcaagcaaacaaatgaaacaagaatacatttaccttaggcaggggtttggctggtttacagtgaagtcctccaacaaaatcaacatttggtaagaatgggcgaggaaattcaaaatcccaataggttcgaatgagccacatttcagctttccccattgtctcaaataatgtagtgggtcttcctgatggaaaaaaacaaaacaaaacaaaaggtagctaacacgagaattgttatttgaatatgcaggtattttcctgaaaggacttggaataacatacccaaacatatataaaatgtctgtgcattgataaaatatatataaatacatttatatatagtcataatttagattttatttattgcatatgttgctcatatgtatatataaggaaggcaatgtattcagagatctgtaagaagaaatcacatctttaatgtaacatcagtatattcacaatcataaataattattaaaataagtcactaatatggtttgactgtccccacccaaatctcctctcatcttgaattataatccccataatccccatgtgtccagggagggacccagtggcaggtgattggatcatggtgtggattcctccatgctgttctcatgatattgagtgagctctcatgagatctgatagttttataagtgtctagtatttcccctgcttgcacttctctctcctgccactaagtgagaagatccaagcttgcttccccttagcctttcaccatgattctaagtttcttgaggcatcccagtcatgtagaactgagtctattaaacttcttttctttataaattacccagtctcaggtatttctttacagcagtgtgagaatggactaatgtagccactatgaacttaaatacacatttgtcttccctctgaagctgcaatagtaacaaatatacctttaaacaactctttcagttccacaattaattcatcttaccttacccatgaaaacagctttccaggaagtactctagtgtctacagtttattaagctagtcccttgatccttggttctcaaagtaaaccatgagttttttgagctcaacactgaaatctttacacctactactgtcttggttcatcttaagatcttaatataattagatttttaaaataaatatatttacaaatgagaattaaaacattttcagaatttattgacatagagatatgtgctctcccttaatttggcccctattttctttgatggagagatgcagtttaataaaatatagattaaaacttagatgttcactttcaacaagatttcagtttttgaaagaaataattgtcaacctgttattgaaggaatgtataaacattagaaatctcaagttttaggcttctgtttctggagtagagccactatattactcaactgtgaaggaatccttcttacatgaaaaacaaaatttaatttctaaatgaggaaactgaggaactcaaagagaaacaaattcctcaatcctgcattgataatttttctagaaatatgtgtaaatactaaatttatgtgtctgccttcatgaagatgtttcttgaggtatctattgactttttttaaagatgaaaaaatgtatagcaaaatgatatgtgatagtttaaagaaatcattagtgctttacaatgaaggtttatgactctctgggtgtcctgtagtagtgatggccccagggttctaactgattctataaggtcaacattctataatatttttgagactgatagatcatcttacatttgcaattcataatttcccttaaaaacactatcttctgacattatatttatataagctcaccttcaaaggcacagaaaagttagaacttaataagcaccagttagacacatgacttacctagaacttcactataaaactggtcccacttcttcagatcataaatttgaaaccaaaagtcaaaataaagcatatgtatcatattttttatcctctccatgaaaatcatttgatcacttaattctgacataacaacaggtacataggaaggagggaacagaaatcctccaccattcttctcaaatgtgtagccaacagagaatcgaagactgtacagaaagggtatgttaaatagttcagccagtagctcaccacagggattaagggcatctgccagaatgacatcaaactttgactcttgtagtttcatcataagtttcttattcaaaactgcatctttacagagcttgttactgtagtcataatattcccaacacaattcttgtaattgtgaaaaatatgaccaaaatgtattttttgaaacaccatatatccatctatcgagaattttcagaagagaatcttccaaataatttttagttaaagatgtaggataaacttctaatttaatagcagatgatttactggcattgacaagagtagaagccgaagatgtcaacacagtcacctcatgacccctctgaacaagctcttccaggattgtcttcatatttatccaatggctgtattctgtgggccacactagcacctttccacagcttccagagctaaagtaacaactgagctgtatcagcagaaagactgacgtccatttcagagacatcctggtcttatgcaatgcttcttttccagttgttgtttctttctgtcatttctcatacttatatctgaggaaaaatcaatcaagttaaaatataactgctaaaatttgaagtaaatacataatactaacagtctgaataggtgcatgccaaggagaccaacaaaagattgatgacctcatatttattttagtgtgtttggtgttcttttatgtttacaattactctagtcaagcaataatttttatgacctagaatatgtaagtaacctgtcttatgtaattattttataatactgttaagaacagtggcaagtgagaggctcctgcctgttcggtgcccttgacatagagagaagaagtaattatacaactcaaacggcattttttaatatcgtggtgcaagtaatgtcttctaaaactttgttgacacataattcatataccatatgactcaccaattagtgtgtacagttcaatgtttcctagtatattcacagaattttacatccactacaataatcagtattatctccaaaagattctatacaatagcctctaaccccccactctgaaattttgcatccatcctaccctaggcaaccactaatctaatttctatctctatagattagcattttctggaccctttaaaaaataaatgagggttttccagtgatcatggcagatgggatgcaggactagattgcagctccagacagagcagcatgcagaggcttgcattgtgaattttagctgcagatcaactgcaagaacagaccagcaattctgagaggatccacacaccctctgcaggaagagtactgctcctgcaggacctgggagacatcccaaacactgtgagtgccccaacaatggaagtgggaaagggtgatccccctctccagaatacacatccccactggagaagctgaagttctgtttgcaggagaagttcctgactttatgtgaagctgagtcaaattagagaaccaagccaagcaaaatacaggggtagaggaagtagcagaaaggcactgggagctctctggatacccaagcggctcattcctgcctggcatcacagggatctatcaggagggtggccagtgatgcagggggttcaaagattctcctcaggacctgaaggcttgaagggatgagtaactcctcccttctcaggcccagccccaagatgcaagaccacttgcatcagcagcgtgtgtcagcaagatagcagaagcaggaagagagccggccagaagacacttaccctggctggaagagatgtacccctgaagatcaagaaataggccatccaggtactacatagcagtcacaacagactgggacacttactgtttacagaggactacaaaacccctgtcccatcctcacttggggctgatgccattttaggcctcagcccacctgcaaccaggcgttcattaaaacagcatgttgctccacaccgcctcctgttgtctgttggcgcgctgttggggttcaaactgattcaagaaccttacatctggtgccaaatcctaggaggggctcaggtctgtgtcgcttgtggacctatccctccaccccagagagcaggccacagcaattagacagaggaagctcctcagcctccagtcgcctctctgtgcatgcgcatcagccactgatctcgcctactggtaagtttcccttggagcccggttaacagggcaaaatctacatggcctctcttggtttctccagtccaaaaatccaacactgatccaagaaggcgccagcgtgcgccaggcactcgctggtcatctggtcttagggggatgcctctaagccatttcatcccgttccaggaaccaaaaaggcagcggagacgataactccttttatcgtctccctccagctgtccaggatggtctcctttttccctgttctctcgagctacccttcattatgggaaactcccggtcctcaattccaaaaaacagccctccagcctgcctcattaaaaatctgcaaaccttaggcctcaggcaagatatctgccataagtgccttgtcttttttatacgataaagcctggtcgcagtatgaattagataacgggtccaaatggcccgcaaatggaacactcagctttacagttttaactgacttaagcagttattgcagatgactgggaaaatggggagaaattccttgtgtccaggcctttttgcactcagatcacagcccgacctctgcaattcttgcttacctgttcaaatccttcttcattctcgccgccctcattgcctttatcctcccgaccctacctctttttcctcattggatggagcagactgctgtccacccctcccagaccctacccctccatctcaaccaacttcattaactccccaagcttcctcattgtcttctcagccaccatcttcccagccaccatcttcccagccagcatcacccacttcttttcctataccatcctctcctcaggaaaactctagcattgcctgtactcattctccttccttacagccctctcacggagcctgtaaacccatcccgccaccttacacccgtatctatcctccaatgcctatcaactcaaccccccttccctcttcaaaccctcagcaggaaccccttctggcttcttccttctctcctgcccatactagctccggcaccatctttggcccatgccccacccgtactttagcgccagtgctagaatgcccccttcgggaagtagcaggaactgaaggtattgttagagttcatgttcccttctccctcactgatctctctcaaactaacaaaagactcagttcatttccagaagatcctacctcttatattagggagattcagtaccttactcagtcttatgaactaacctggcatgacagctacttatcttctcttccaccctcaccccagaagaccagcaccgtacttggaccctagctcaggtgcatgctaatacaattcatcatcaagctcctgcccagcctactggcacagaggcagttcccaaccaggacccccactgggattatcaagacagggcctctggacacagccatcaagacctcatgattatgtgtctccttgcaggactcaaaaagggtgcccataaagtggtaaactatgaaaaactttcagaaatcaccgaaggtcctgacaaaaacccagccctttttctctcttgtttaactgaagccatgagaaaattaccaacctggacccagccagcccagaaggaaccactatttcaaaccttcagttcctcacccaatctaccatgatatttggcgcaagcttcagaaggttgatgacggccctcaaaccccacagtgggaccttcttaatttagccttcaaagtctttaacagttgtgatgaggaaagtaaaagaaaaaaacagtttccaatgcttgcctttaccctgcaggcccacagggccacagctccatacagaagcctcctagcaaaacacctccacctggcgcctgtttcaagtgtggcaatgaaggctactggtccaggccatgcccaaacccagctgtgctcaccaggctgtgccccctctgtggaggactcagtgaaagtcaggctgtgagcggctccagcaaggatcgcctccatccctttccgagctggccaaaacctcctactcggatctcaatggccttgccactaaagactgacagtgccctggaacagatgtcccagcaactaccattgcttcatctgagccaagggtaaccctgatggtggcaggtaggcatgcatgttttttaaaaattaatattggagcaacctactctgctttacctaaattttcaggacccacccagtcctcccaagtctctgttgtgggaatcaatggacaagtctccaaaccccaagacccccctccacttttctgctccctgaacaccttttccttcagtcactctttcttagtcctgccttcatgcccagctccgctcctaggcagagatattctttcaaaactccacactactctccacttccacattccccatagtacccaacacatcaacccagacccctccaaggcttctaacaggcttctaaccttcttctactcctccgacctcccaccctgaaacatgcaacttttccttatcccccacctgtagttaaccccactgtttgggatacttccacaccctcggtcacagagcaccacacccccatccacatcacccttaaagagcccaccccgttcctatcacagaagcagtatctcatcccccaagcagctctcataggcctaaagcctatcatttctctcctcctcaccagtcacctactctgcccaacaaactctccttttaacacatcagttctacctgttaaaaagccagatggaacttatcacttagtccaggacctcaggctcattaaccaagctgtactcccagtgtgtccagtagtttctaacccatatactttactttcctcacttccctcgaataccacccacttttctgttctaaacctaaatgatgctttttcacaattcctttacaccctgattcccaaaacctctttgcctttacctgggaaaaccccgacacccacctttcaggtcagctcacctggtgcgtactacctcaaggttttagagacagcccccacctttttggacaggcccttgctagtaacttctgtactttatccctaaaatcatcctctcttctttaatatgttaataatctgctcctgtgtagcccctctcaaagagactgcaacacccatacatactatctcccttttaaacctcttggcagaacaggggtatcaggtctcccctaagaaagcccaaatatgcaccccccagtcacctatctaggcctagctcttacccctgaatgcaagggctcacaacagaccacatactccctccttcagtccctcccgcctccacaaactaagcaagaaattctctcttttccaggattagcaggatattttaagctctgggtttcctccttcgctctacttaccaaaccgttgtaccaagctgctaaaggccctctccatgagcctttaaaacctgcacagcctattacccaacctttccatctactccaaaagtctctcatctcagcccccatcctcactctcccagacttcaccaaacctttctccctctataccgatgaatggcgtggagttgcactaggtgttctaacccagtctaagggacccacccggccaggttgttgcctacctccctaaacagcttgaagccacagttctcggatggcctgcctgcccctgagcattggtggcagttgctgtcctcactcttaaaagcctaaaactatctcttcatgccaacctaacagtttattcaacccataacatcaaagacatgttagctcaccgcagtgtactaagtcttttctctgccccacggctcctccagctgtatgctctattcatagaaactccccacatcaccatgctaaccacctcccatctaaacccggccatgctcttacccgaagctacaaccgcccaagactcttcttcacactcttatgtgtgaatactgttcaaacctttcttataccttttccaaacctaacagaaaaatcccttccagatgcgtcctttactcggtttgtagatggcagctccttcctacatcaaggacaccgacatgctggctatgctatagtgtcaccccccaacactattgaagtcaatctgctcctcttaggcaccacctcccaaaaggctgaactcattgccctcactcgagctctcattctagcatccggaaaacagatcaatatattcaaattctccttatgtgttccacgtagtgcactcacactcatccatctggaaagaacggggtttcctcactgcaaacaatactgtcataagtggctctctcatcagcaagctccttcaagctgccaggctcccacagaaagttgccatcattcattgcaggggccaccaaaccccagacaatcctaaattggctggaaatgtgctagcagatcaggtagccaaacaagtagccctactaccctttcgaggccagttgctgtccttgtccttgttctctcctctttacttctaagaagaaaaagatttccaagcccaaaaccttcaaaagcaaggacgatattatgtcaaggaagggtgcttagttattcctcactctcaaagccttcctcacctccaaagcctccacaactctttccatgttggttaacaacctcttgcagcttctccacgctattctcacttgtcgtcacttttccagccatgttcaagaaattatccagtcctgctctatctgccactcaatgtaaccccagggatccctccagcctctgccttttcatacccaccaagcccagggccagttacctggggaagattggcaagtagacttcactcatatgctgcatgataaatgtctctgctatcttctaatccttgtctgtactttctctggctagggagaagtgttcccaacaacttcaaaaggtgcaaatatcatcacacaaactcatcatgcatacagttccctgtttcagactcccaacatccatccagtccgataacagtcctgccttcatcagccacattacccgaggcatctctacatccttaagaataagtaagttctccacacaccctacacacctcaatcttcaggcaaagttgaaaaaattaactctgtccttaaagcctaactcatcaagccggctctagaaacctgcgagtcatggacaaaaaaatctcccttttgccctcatgagactttgcacaacaccaaaagcaccctctttttttgtttttgtttttgtttttgttttgttttgttttgtttttattatactttaagttttagggtacatgtgcacaacgtgcaggttagttacatatgcatacatgtgccatgttggtgtgctgcacccattaactcgtcatttaacattaggtatatctcctaatgctattcctcccccctccccccaccccataacagtccccagtgtgtgatgttccccttcctgtgtccatgtgttctcattgttcaattcccacctatgagtgagaacatgtggtgtttggttttttgtccttgcaatactttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgcagcaataaacatacatgtgcatgtgtctttatagcagcatgatttatagtcctttgggtatatacccagtaatgggatggctgggtcaagtggtatttctagttctagatccctgaggaatcgccacactgacttccacaatggttgaactagtttacagtcccaccaacagtgtaaaagtgttcctatttctccacatcctccctggcacctgttgtttcctgacttttaatgattgccattctaactggtgtgagatggtatctcattgtggttttgatttgcaattctctgatggccagtgatgatgagcattttttcatgtgtctgttggctgcataaatgtcttcttttgagaagtgtctgttcatatcctttgcccagtttttgatgcggttgtttgtttttttcttgtaaatttgtttgagttcattgtagattctggatattagccctttgtcagatgagtagattgcaaaaatgttctcccattctgtaggttgcctgttcactctgatggtagtttctgttgctgttcagaagctctttagtttaataagatcccatttgccaattttggcttttgttgccgttgcttttggtgttttagacgtgaagtccttgcccatgcctaatgtcctcaaagtattgcctaggttttcttctagggtttctatggttttaggtcaaacatgtaagtctttaatccatcttgaattaatttttgtataaggtgtaaggaagggatccattttcagctttctacatatggctagccagttttcccagcaccatttattaattagggaatcgtttccccatttgtggtttttgttaagtatgtcaaagttcagatggttgtagatatgtggcattatttctgagggctctgttctgttcccttggtctatatctctgttttggtaccagtaccatgctgttttggttactgtagccttgtagtatagtttgaagtcaagtagtgtgatgcctccagctttgttcttttggcttaggattgacttggcaatgtgggctcttttttggttctatatgaactttaaagtagttttttccaattctgtgaagaaagtcattggtagcttgatggggatggcattgaatctataaattaccttgggcagtatggccattttcatgatattgattcttccttcccatgtgcatggaatgttcttctatttgtttgtatcctcttttatttcattgagcagtggtttgttgttctccttgaaaaggtccttcacatcccttgtaatttggattcctaggtattttattctctttgaagcaattgtgaatgggagttcattcatgatttggctctctttttgtctgttattggtgtataagaatgcttgtgatttttacacattgattttgtatcctcagactttggtgaagttgcctatcagcttaaggagattttgggctgagatgatggggttttctagatatacaattatgtcatctgcaaacagggacaatttgacttcctcttttcctaattgaataccctttatttccttctcctgcctgattgccccggccagaacttccaacactatgttgaataggagtggtgagagagggcatccctttcttgtgccaattttcaaagggaattcttccagtttttgcccattcagtatgatattggctctgggttgctcatagatagctcttagtattttgagatacatcccatcaatacctaattcattgagagtttttagcaagaagcgtcgttgaattttgtcaaaggccttttctgcatctattgagataatcatgtggtttttgtcattggttctgtttacatgctggattaagtttattgatttgcatatgtagaaccagctttgcatcccagggatgaagcccacttgatcatggtggataagctttttgatgtgctgctggattcagtttgccagtattttactgaggatttttccattgatgttcatcagggatattggtctaaattctctttttttttgctgtatctctgcgaggcttcagtattgggatgatgctggcctcataaaatgagctagggaggatttcctctttttctattgattggaatagtttcagaaagaacggtaccagctcctccttgtgcctctggtagaattcggctgtgaatccatctggtcctggactttttttggttggtaagctattaattattgcctcaatttcagagcctgttatcagtctattcagagattcaacttcttcctggtttagtcttgtgagggtgtatgtgttgaggaatttatccatttcttccagattttctagtttatttgcatagaggtgtttacagtattatgtgatggtagtttgtatttctctgggattggtggtgatatccccttaatcattttttattgcatctatttgattcttctctcttttcttctttattagtcttgctaacgatgtattaattttgttgatcctttcaaaaaaccagttcctggatttattgattttttgaaaggtttttgtgtctctatttccttcagttctactctgatcttagttatttcttgctgtctgctagcttttgaatgtgtttgctcttgcttctctagctcttttaattgtaatgttagggtgtcaattttagatctttcctgcttcctcttgtggggatgtagtgctataaatttccctcgacacactgctttgaatgtgtcccagagattctggtatgttgtgtctttgttctcgttggtttcaaagaacatctttatttctgccttcatttcgttatgtacccagtagtcattcaggagcaggttgttcagtttacatgtagttgagtggttttgagtgagtttcttaatcctgagttctagtttgattgcactgtggtctgagagacagtttgttataatttctgttcttttacatttgctgaggagagctttacttccaactatgtagtcaattttggaatagatgtggtgtggcgctgaaaagaatgtatattctgttgatttggggtggagagttctgtaaatgtctatcaggtcaccttggtgcagagctgagttcagttcctggatatccttgttaactttctgccttgttgatctgtctaatgtttacagtcaggtgttaaagtctcctattattattgtgtgggagtctaagtctctttgtaggtctctaaggacttgctttatgaatctgggtgcccttgtattgggtgcatatatatttaggatagttagctcttcttgttgaattgatccctttaccattatgtaatggccttctttgtctcttttgatctttgttgttttaaagtctgttttatcagacactaggattccaacccctgcctttttttgttttccatttgctcggtagatcttcctccatccctttattttgagcctatgtgtgtctctgcacgtcagatgggtttcctgaaaacagcacactgatgggtcttgactctttatccaatttgccagtctgtggagtatttaacccatttacatttatttttaaatgtattggagtatttagcccatttacatttaaagttaatattgttatgtgtgaatttgatcctgtcattatgatgttagctggttattttgctcattagttgatgcagtttcttcctagccatgacggtctttacaatttggcatcttttgcagtggctgctactagttgttcctttccatgtttagtgcttccttcaggagctcttttagggcaggcctggtggtgacaaaatctctcagtatttgcttgtctgtaaaggattttatttctccttcacttatgaagcttagtttggcgggatatgaaattctggattgaaaattcttttctttaagaatgttgaatactggcccccactctcttctggcttgtagagtttctgtggagagatctgctgttagtctgatgggcttccctttgtgggtaacccgacctttctctctggctgcccttaacattttttccttcatttcaacattggtgaatctgacaattatgtgtcttggagttgctcttctcgatgagtatctttgtgttgttctctgtatttcccgaatttgaatattggcctgcattgctagattggggaagttctcctggataatatcctgcagagtgttttccaagttacttccattctccccgtcactttcaggttcaccaatcagatgtagatttggtcttttcacagagtcccatatttcttggaggctttgttcatttctttttattattttttctctaaacttctcttctcatttcatttcattcatttgatcttccatcactgataccctttcttccagttgattgaattggctactgatgcttgtgtattcatcaagtagtctcatcctgtggttttcagctccatcaagtcctttaaggacttctctgcactggttgctctagttagccatttgtctaattttttttcaaggtttttaacttctttgccatgggtttgaatttcctcctttagcttggagtagtttgatcatctgaagccttcttctctcaactcatcaaagtcattctccatccagctttgttccatttctggtgaggagctgcattcctttggaggaggagaggtgctctgatttttagaatttccagtttttctactctttttttttccctatctttgtggttttatctacctttggtctttgatgatggtgatgtacagatggggttttggtgtggatgtcctttctgtttgttggttttccttctaacagttaggaccctcagctgcaggtatgttggagtttgctggaggtccgctccagaccctgtttgccttggtatcagcagtggatgctgcagaacagcggatattggtgaacagcaaatgttgctgtctgattgttcctctggaagttttgtctcagaggagtacccggccatgtgaggtgtcagtctgcccctacaggggagtgcctcccatttaggctactcagttgtcagagacccactggaggaggcagtctgtcctttctcagatctgcagctgcatgctgggagaaccaatactctcttcaaggccatcagacagggacacttaagtctgcagaggtttctgcttccttttatttggctatgctttgttcccagaggtggagtctacagaagcaagcaggcatccttgagttgcagttggctccacccagttcgagcttcccagctgctttgtttacctactcaagcctcagcaatgtcaggcacccctcccccagcctcgctgccaccttgcagtttgatctcagactgctgtgctaggtatgagtggggctctgtgggcataggaccctctgagccaggcatgggatgtaatctcctggtgtgccgttcactaagactgttggaaaagcgcagtattatattaagagtgacctgattttccaggtgccatctgtcaccgctttctttgattagaaaagggaattccctgaccccttgcacttcctgggtgaggcaatgcctcaccctgctttggctcatgctcggtgcactgtacccactgtcctgcacccactgtctgacactccccagtgagatgaacctggtacctcagttggaaatgcagaaatcacccatcttctgcatcactcatgctgagagctgtagactggagctgttcctattcggcctagctaattattaatatttcttttcttatagtaattttggttttggtttgttcttgcttttctagtcatttgagatagatcattacattttttatatgaaacctttctccttttcttgtgtaggcatttcttgttctaaacttgtctcttaatagtgcttctgttgaatctcacagattttgctattgcatgatgtgatctttctttgttttaagcaatttcaaaattgtttcttttttatctattggttataaggaatatgttgttaaattttcatggatttttctagttttgtcttggcattgattttataatttatttcattgtgttcagataaaataattagtaaaatttttattttttaaaatttgttgagacttgcttaatgtcctcatatatggttaattctggggatgttatatgtgctataaaaagaatcttacattctgcagctgttggttaaaatgttctgtaaatatcaactacttcaatttggtctatggtacagtttaaatctcatgttgctttattgtctaaatatctgtccaatgctgaaaaggtgatggtgacatcctcaactattattggacttaggtctatctctcctttcaggtataataatatttgcttcatatatctcagcggttcatggttggttgcatatatatttacatttttgtctttttgaacaattgattcatttattatcatattaagtctctcttttcctctcaaaattttggcttaaagtttgtgttttgctgaggtaagtgtagctatttctgcttgatttgggtttctgtttgcatagcatatctatttcatcttttcaattgcagtctatgtgtaactttattggtgagatgagtatcttttaggctgaatattgttgagtcttgttttttaatccatcaatctacgttttcagttgtgtaatttaatccacttattttcaaggtatttatttatttataggtaaaggcttattcttttatttttttctgtttattttgtatctcccttattccttaatttctctattacttattttgacagtttgatagttttctatactgataaagtttgattattttttctttcacctttgtctgttggctgtatgagtgagttatataattttgtgtgtttttatgaagtgtattatcatcttttcaccttcagatgttagacttcctcaaatattccttttaaggctggtttaatggtaataaattctttatgtttttgcttgtttgagaaatactttattcctctgtctctgttttttttgtaggatcaaagtttgctttatataatattcttcattgacatgattataaaacaaattttatcacttagcatatattttcctattctttcctggcctataagttaatgctgagaaatccactattagctgaatggagattcccttatagatgatgtgtcagctttcttctgccatttttagaacacctgctttgcatttgacttgataatttgacgatatgtgcatcagtgaagacctttttggattgaagtaacttggtggaactttcagcttcttggatctagatgttcatcttttgtcaataacttaagaagctttctgctattatttcattgaatataatttctatgctgtttatcttctcattctagaattttcatcatgttaattttttttcttttttacttagtgatgttgcataaattctgtaggattactttattctttttcttctttcttgtctatgtgagtcatttcaaaaacatggtaatagttggaaattatttcctctgctttgtctcttatgttcttgaagctctcaatagtatatttttaaaaaaatttgttcattgctttaaagtattttatatttttgtgggtacatagttggtggatatgcttacggggtacatgagatattttgatccaagcatgttctagtgaaaaatttttacaatgaacaattcaataaagttgcagaacatgaaattaacagacaaaatcaataacatttctatttgcctacaatgagcagctgaaaaagaaatcaaaaaagtattcccatttacaatagtcacaaataaaattgaacatctaggaattaaaggactgaaagatctctataatgaaaactactgatgtaagaaattaacactgatgtaagaaaacactgatgtaagaaattagagggtaccaagaaatgaaaaaatattccatgttcattgattagatgaataaatattgttaacatttctatattaagcaaaacaatctactgatgcaataaaatcatgaaaataccaattacattcttcacagaaatagaaaaaaatctcaaaatgtatatgaaaccggaaaagacccagaatagtcaaaggtatcctaagcaaaagaaaccaacttggagtcacattatctgacttcatattacactacgcacctatagtaaccaaaccagcatgttactgccataaaaacagacacagagatcaatgaaacagaatagagaacccagaaaacaatctacacacctgcagtgaactcattttcatcaaagttgccattaacatacacagaaaaaaagacagtctctttaataaatggtgctgggaaaacagaatatctatatgcagaagaatgaaactagatccctagctctatccatatacaaaaatcaaataaaaatggtttaaaggcttatatctcagacctcaaattatgaactactacaagaaaacattaaagaaaatctccaggatgtttttctgggccaaaatttcttgggttataccccataatcacaggcaaagtaaaaatgaacaaatgagatcacatcaagttaatcagcttctattcagcaaaggaaacaatcaacaagtgaagagacagtccacagaatgggaaaaatatttacaaactatccatctgacaaggaattaataaccagaatatataaggggctcaaaccctctataggaaaagataaaaaaatggacaaagaatttgaatagagatgtttctcaaaagtaaacagaaaagtggcaaacagacatgtgaaaagatgctcaatatcactgatcatcagagaaagtcaaatcacaactaaaatgagacatcttctcacaccatttaaagtagcttatacccaaaagacagacaaaaataaatgctgatggggatgtgaagaaaaaggaaccctatacaattttggtgggagtgaaaattagtaaagaccactatggagaacagttgacggttcctcaaaaaaatgaaaaatagagctaccatatgatccagcaatctcattgctagatatatacccaaaagaaataaatcagtatgtcaaagagatacccgcactcccatgtttgttgcactatttacaatagctaagatttagaattagcgtgaatgtccatcaacaaatgaatgaagaacatgtgttgcatagacacaatggagtaccattcagccatgaaaaagaatgagatccattcattttcaacaacatggatggaactggagctcattgtgctaagtgaaataagccaggcacagaaagacaaacatggtatgttatcacttatttgtgggatctaaaacttaattaaactaatgaacatagaaagtagaaggctgattacttgagcctgggaagggtactgggggcatgggggtaagcagggattttaacaggtacgtaaaaaggaataagacatactatttgatcacacaacagggtgactatagtcaataataacttcactgtacatttttaaataactaaaatagtgtaattatattgtgcataagacaaagtaaaaatgcttgaggggatagatactccattctccataatatgcttatttccaattgcatccctgtatcaaagtatctcatgtactccacaaatatatacatttactaggtaaccacaaaaatttttaaaaattgaaaatttaaaaatttgaaagatatacttaatggaaaaacaagcaatttgtaatacaattattttatgtaataaacaattaggggacaggtttcaaaaactattgacttggatttagtaacaacagtaagtattagcaattatcatgattgtactattagtcattctttcacttgtcctacttccctaccaactcttccgtttcctggtggcactattaatttcccttaatgtacatgggaaaattattaaaatataaagttagattgctttgaatttttattagtatttcatcaacttttatctcacgagaaagttaccatgtagaccttatataatttgcattcaacatggatattatgttttagccattgaataagattttagttgtatgttgatgctaataagaaggtaaacagaaatgatcccctaagagactgtataataatgttgcaaagaataattgctatctatatatatcttaaaagtgtgatattaatttaaaacacatgagattcttgtgttctctcataaggaatattctatagaataaataattgttattatgaactaagggcacttttcagatacaagtggtagaaattatttggtttttattaggcaagcacttttcatttttttcttggattctctgagatgcaggtatgacgttgagacataagttgccccagggagctttcctgagttgtcctgcaggcttggcataaggtggaaaaacacctgttcttatagggtaaaatgacctttttttgctgtaacatgtagacctctggaatctcagggatgaatggtttaaatgctggagtgaaagcaagtaaacactgggttttgttgcaaatattttgggggcacaatttctttttatgttgaagaatggtgtacattttaagctagaatactggtgaagagccccaatccttacaatacatcattagcatttcaccttgctcatctgtttgcaaaaacttctgcttctgcttttaaacaagtccacaggatatctgtcatctataacattgctagagaatgtaatgttgatgtgctagatgataatcagtatctattaaatgaggaatgatatctcaggtgactggcatatgataggtaattaatgttattggaaataacaaaaataaccaaaattgcaatattaatatttctggatcactgacttagtgccagacacattttaagtgttttacctgctttaacttttttccacaatacaatataaagctggcaaaagtacacataaatatctctatcaacatgctggtatatttttctatcatttgctgcctgattttattaaaaaaattctaaattgtgtattctttttattctgaccctctgcagtctaattcattgaatatcttggaaactttttaaaggaaggaaatataatcagatctctccatttgttaactctttttagtagcttcccaatgccataataaatatttcaagatcctaataattatttggctccaacttgcctcttcagaatcatctgtttcttagtattcttctgcaaactaaacttgaagacttgagaactgtctttactactttgcctgcttttccttttgtgtcttcctctccccctcattcatcacctatttcttcacacctttcagttctcatcttgattatccatgtctccagtatactttctgttatcccaactggatatatccttgttattgtggtactgaagataatgcttttcacacattttattacttgcttatattttatctttcaacatagagtttaaggaatgtggggacagaaactatgtctacttttcttgtcttcttaaaatccaaagcagtggtttgtgtgaagcactttataagaagtattgtttggttgaataactaatactttcttatatgttgcaaaatgaaggctttaatttgaacattactaggttcagatagtctctagtagtactcttttttctgtagtaataatgaaattcatataattgtgatgatatagaaataggaatctttaattggcatctggtttaccccacccactaaacatctttctttcacttcaagcaaaaacactgaaagaagaatatagtatcattcccaccaaaaatttaagacaaacaaaacaaaacaaaacaaaacaaacaggtttttttttttttttttttttttttttttttacctttggcagggattttgcaggtttgccgtgaagttttccaacaaagtgaacattttgtaagtgtgggtgaggaaattaaaaattcctgtagttttgaagaagctttgtttcacttttctccattatctcagataatgtagtattttttcataatgggaaaaaggaaaacaaaggcatatgacacaagataattgttatgagaatacaactgataattatctgaaaggagttagaataatgtagccaaagatatataaattgtctatgcttagataaaacaatatacatgtatttatacctggggataatttagtttttgtgcattatctattttgctcatatgtatttacaagaaagaccaagtgctaagagaattgtgggagaaaacttattcttctatcacatcagtgtattcgccatcgtaaaccataattaaaataaaccttagagaataaaacatgcatttgtttactctataaagcagcaatagtaatagatatacacttaaaacaagtctttgaggtccatgatcaatggattctactctactcataaaaaacaattttctaagaagtactcaatttttttcaaaaattaagctagtcccttgatcttttgttcttcaagtgaactgttgagtattttgtgagtatggctgaaatccttgtacctactactgctttgggttcatgctaaggtcttaataatgttagattttaagtaaacatattgtcaaatagcagctgaaattttttcagaaattattgaaatagagacttttgcctaacatggatttcactcatattgttcttagtgaagagacatagttaaaaaaaaaactatacagaagtaacttgatgttcacatttcaacagatgtttgactttaagacaaatgattttcaatcctttagtgaaggagtataaagatactagaaacttcaaattacctgcattgatttttgagtctttgatagagaaattgtatcgttcaattgtgaaggaaacattatggtactgtgggaaaatattttaatttctaaataagggacctgagatacacaattcaaaacaatcccctcaatgctaactagatagttgtgctagaaaaatgcataactcctcaatctacatgtctgcattcagcaggatgtttcttgatgtgtctaatgacttttcttaaatgaaaaatatgtcaagtaaaatggatgtgtgattgctgaaagaaatcctaatgacattaatttataggtttatgagttcctggagtgtgctgtattagtgatgaccacagggttctaacagatgctataatgtaagtctttccataatatttgtgagattgatagattattttatattttcatttcctcatttcttttattgaaaaacagtacttctctgactttatacgtacttaccttctgttttagttaattttcacactgttgacaaagacatactcaagatgggataaaaagaagtttgaaggactcacagttccacgtggctgggaaggcatcacaatcatggtggaatgcaaagagcaagccacgtcttacatggatggcagcaggcaaagagagagaacttgtgcagggaaactaccccttataaaaccatcagctattgtcagacttattcactatcatgagaacagcacaggaaagacctgcctccatgattcaattacctcttactaggaccctctcacagcacatgggaatacaagatgagatgtgggtggggacacagtcaagccatgtcattctgcccctggcccctcccaaatctcatgtccccacatttcaaaaccaatcatgccttacagacagtcctccaaagtcttaactaatttcagtattaactcagaggtccacagcccaaagtctcatctgagatgagacaagtgtcttctgcctatgaacctgtagaatcaaaagcaagttagttaattcccagatacaatgagggtaccagcattggataaatacagatatttcaaatgggagaaattggctaaaatgaaggggctacaggccccatgcatgccagaaatccaacagggcagtcattaagccttaaaattacaaaatgatcttttttgacttcatgtctcacatccaggtcacactgatgcaagaggtgggtttccatggccttgggcagctccacacctgtggctttgcagggtgcagcctccctcccagctgctttaaagggctggcattgagtgtctttagcttttccaggtgcatggtgcaagttgttggtggatctaccactcaggtgtctggaggatggtggcccttttctcacagctcctttaggcagtgtctgagaagcaactcagtgggagttccaactccacattttccttcttgaagtccctaggctacacagaatactgggacgatttttttctttctagcccaccaggcctgtgatggaaggggctgccgtgaaggcctgacatgctctgaagacatttcccccattgtcttggtgattaacatttggctcctcattacttatgcaaatttctgcagccagcttgaatttttcctcagaagaagttaactcttatggtttaatgtaaacacagtatattaaaagtctaagtatgtgcatggcaaagagacaaacaacttgctctttacttgagtctttaatgtcccttttatgtttgtaaatgctattatccaggtagtatcaataattttgtgtggatgagtcacttattttatgtaatatattttacaatagtgtcaagaacattcacagtgagaagttcctttagttctgcaatcactttgagatggaattaaagatgaaaataattatatgagtatatcagcatttcttggatattgtgcttcaaggaattttttggtaaaagttgacatataattgctatgctatacaatttactgattattttgtaaaatccattatttgtggtatattcacagaattgtacatccatgacaacaatcagtttcagagcacttttatttgtatcacaaaataaaccctgtactctttagtattttttcctcaccctgagtttctgcatttctcctgccctgctcaattgctaattaaatttgtatctatagatttgcctattctggaaattttaaaataaatataatcgtacaatatatagtttcttgtgactggcttccttcatttagcataacattttaaaggttcatttatgatgtagcatatgtaaggacttcattcctttttaatggcaaaataaacattttatatatgagcatacacattttatcgatttatttatcagttgatggacattaatttttccctatttttggctagtatgaataatgatgcttatgaacaagcttagtgtaactgtgttttcatttctgtcagatacatattcttagaagtagaattgctgtgttgtgtttccttgcatgtttagctataaaaggttaaactgtacgtgtaaacttttgagaaattgctagactgttttccaatgtggttgcaccattttccattcccatcagcaatgtgtaagtgttacaatgtctccacatcgttttcaacaaatgattatgtgtctttttattacagctaggctggtgggttgaagtagtgtcttgtggggaaaagaaagagagatcagactgttactgtgtctatgtagaaagaagtagacataagagactccattttgttctgtactaagaaaaaatcttctgccttgagatgcagttaatcgataacactagccccaaccctgtgctggcagagacacgtgctgtgttgactcaaggtttaatggatttagggctatgcagtatgtgctttgttaaacaagtgcttgaaggcaatatgtttgttagaagtcatcaccactctctaatctcaagtacccaggcacacaatacactgcggaaggccacagggacctctgcttaggaaagccaggtattgtaaaaggtttctccccatgcgatagcctgagatatggcctcgtgggaagggaaagacctgaccgtcccccagcccaacacccgtaaagggtctgtgctgaggaggattagtaaaagaggaaggcctctttgcagttgagataagaggaagtcatctgtctcctgctaatccctgggcaatggaatgtctcattgtaaaacccgattgcatgttccatttactaagataggagaaaaccaccttagggctggaggtaagacatgctggtgacaatactgctctttaatgcaccgagatgtttatgtatgtgcacatcaaagcacagcaccttttcttaaccttgtttatgacacagagacatttgttcacatgttttcctgctgaccctctccccactataaccctattgtcctgccacatccccctctcgagatagtagagataatgatcaaaaaatactgagggaactcagagaccagtgccagtgtgggtcctctgtatgctaagtgccggtccccagggcccacttttctttctctatactttgtctctctgtctctttcttttctcagtctcttggcccacctgacaagaaacacccacaggtgtggaggggctggcccccttcagtatctcattgttgattatatttccttggtgtctaatgatgttgaacattttgactttgcttataagccactgtattttttttcttttttggagaaatttctattcacatccattgcccatttttaattaatttctttttcttattaagttgtaagtcgtatttctgatacaagtacttcattagttatatcatttgaaaatagattctaagattatgtgggcttttgttttcttgatgctgtcctttgaagcacaaaagtactaaatttgataaagacctatttatatatttttcatatttgattgcttatgcttttgatgtcatatgtaagaaaccactgccaaattcaaagccatgaagattatcttctgtgtgttctttttggaattttatgattctacctcttaaatttaagcctttgacctacttttagtagttttgtaaatggcttgagaccagaagtcaaactttattcttttgtttgtgggcaatccgttattcaataagcatttgttcaagactgttcaattttttcattgaattgttttggcatctttgtaaaaaaccataaatatgtgggtatgtttctgggttctaaaatctattttgtttgtatatatgtctatttgtatgcctataccaggctcatttgattattatagatttgtagttggctttgaaagaagaaagtgtaaatcttccaactttgttattattattattattattttcagacaggatcttactctgtttcccaggctgaagtagagtggtgtgatcatggctcactgcagccttgaactcccaggctcaagcaatcctatcaccttagcctactgagttgctaggaccacaggcatgtgtcacctctcctggctaatatattattattagtattataaagacaagagtctccttatgttgcccaggctggtcttaaactcctttgctcaagtgatctacctgccttggcatcacaaagtacaactttgttctttattttaagacttttttggctatctttaggtttcttgaatatctttgtgaatttcagaattagtttgtcaatttactggaagaagccagttgggattttgatagggattgcattaaatctgtatatctatttggggagtggagtatggacactacaacaatactgtgttttaatctgtgaacatgagatgtctttccatttatttacatcttttaaatttctttcctctatgctttacagtatccataatgcaagttttacacttattttgttaaaattgattcctaatagttatattcttttggatgttatttgaagtgcaattgttttcttaatttcattttggatatttcattgcaattatgtaaagtaatttttttgtttattgatcttttatcctgaaaatttgctttgtttattgttccaatattttttctagcagattcctaaagattttctagatgtaaggtcatgtcatatgccaaaagtttaacttctttcttttcaatgtagatttatttttttcattttcttgcctttatcttgactagaagctccattaaaatattcaatatagataaagagtggatttagtctttctccattaagtatgatgttagctgtgcattttttacagataacacttaccagtttgagaaagtttccctctatccctactttacggggtactgttataatgaaggatattgaattttattaaattaatttttctgcatttattgagatgatcatgcagttttatttttctgttctaattacattttgtattatgttaatagagattttaacgttaaagcaactttgcatttttaataaaacttttacttattcagggtatataattgcttctgtatattcttacattcattttgctagcaaattttgtggatttctgagttcataatcataagatttatcgatctgtagtttttattttttgtgatatctttgtgtggttttactagaaggaattagttaaatatgttgataatgcatttttcttttctgtgatttgaaggattatttttgaggaattgttaatttttctgctttaaatgacttatagatttcaaaataaaggcatcttgacctaggcaattctttgtgggttgtattttggaccaattcagcctctctttttgttataggtctattcagatgttctgtttctttttgaatcagtttaatatattttcttgtctgtgtcttcctgtagtagaatttatgtcaaattaagttgggagtgggtgagggagcagttcatggttgaaattaataggctctcattatttttaccaggacttagtagattttcttgaataaatattgctaatattacgctttataattttaggtcaatgcctggacactttaattttttatagaaaacacaatattttaatgctaaagatgtgtttaaattgtttcttttttacaattgtgatgttctatgaagatttaaacttttgactgttaacagatgatttaaatagaaatgtagcatatgtactcagtgtacatgtgtatattcagcttgtcagcattgagttatctttcataaacttatatttatttatttgacacaaccaggtgggaggggttcccagagaaacaccagagagcctgtgcactgggaggagtgcacactggggtggagccacagaagttcatatgatttgcagtgaggaggagcccggcccctcctcttcttggatggaacctggaattcagtctgtgaggtggcaaacccaccggcaggaaaacacactctctcacttcactaagagcctctgttttgccttttcttcctttttacctaacaaaactctgcattattcaccttcaaagtccgtgtgcctaatttttcatggccatgtgacaagaaccttgcttttagttgaactaagaaaaagtcccacaacatatagatacacacacacgcacacacacacacaggcaaaaatgcaaaaacattcctcattttattttgttttacagatatggtcttttttacaaattgaaagcttattgctgccctgcattgggcaagtttaccagtgccatctttccaacaggatgtgctaactctgtcactgtggcacattttggtaaatttcacaaagttccaaacatttttattattattatatttattatgatgagttgtgataactgattgttgattttactgtagtattgtgttgcgggcaccagaaactgtattgggataatacgataaacttaactgataagtgctggtgtcttctgactgctctaccaaccagcctttcccccatttctctctctctccttaggcctctctatttcccgaggcacagcaatgttgaaatcaggcaaattagtaatcctacaaatggcctctaaatgttcaagggaaaggaaggctctgtcatctcaatatcaaaagctggaaatgattaaacttattaagaaaggcatgttgaaagctgatacaggctcagatctgtacctcttatgccaaatagttagccaagttgtgaatataaaaaaaaaatttgggaaagacattaaaagtgctacacatgtacacatgaatgatatgaaagtgcaacagccttgttggctggataaaagatcaaaccagtgacaatagtccccaaatttagacaaagcctaaaccagaacaaggccataattctctccaatgctgacaggggtgaagaagaaatctttgaatctagcagtggttggttcacgaagtttaagggaataaaccatctccataacataaaagtgcaaaataaaagaagctacagaagattatccagaagatgtagccaaaatagttactgaaagtggccacactaaacaggagatttttccttgtgtacagagcatctttctcttgaaagaagataacatttagcttttttatatcttcacaggagaagtcaatgtctagcttcaatgcttcaaaggacaggatgactctttcattagaggctaatgcagctggtggcttgaagttgaagccaattttttttttttttttagatggagtcttgctctgtcacccaggctggagtgcagtggcaccatctcagttcagtgcaagctccacctcccaggttcatgccattctcctgcctcagcctcccgagtagctgagactacaggcaaccgccaccacgcctggctaattttttgtatttttagtagagacggggtttcactgtggtcttgatctcctgacttcatgatccacccacctcggcctcccaaagtggtgggattacaggcatgagccaccgcacccggttgaagtcactgtttatttaccatttggaatatcctagggccttagataaattattctaaatctactctctctgtgctctattaatggaatatcaaagcttggttgataacacatttctttacagcataaattactaaatattttaatcccactgttgagatctattgaccagaaagaaatattcctttagaaatattagcattcattgacaatgtacctggtcacccaagagctcttatggagatatacagggagatcaatgttgtttttatgcctggtaatacaacattcattctgtaacacatatatcaaaaagtaatttcaacttttaagtcaattaaggaataagtttcgtaagattattgctgccattaacagcaatttctctgttggacgttgtcaaagtaaattcaacactttctggaaaagtttcacctttctagatgatattaagaacatttgagtcattaaatgaagtaaacatatcaacattaacaggaatttggcagaatttgatttcaaatatcatagataatgttgagagcttcaagaattcaatggaagaagtaaccacagatatggtagaaatagtaagggaactattactggaattaaaagaagaacctgaagttgtgactgaattgctataatctcatgataaaacttgaatagatgagttctttcttatggatcagcaaaaaaatttggtatagtgagatagaacctactcctggtgaagatgctgtgaacattgttgaaatgacaacaaagtatttagaatattacttaaggttatttgataaagcagcagtagggtttaagtggattgattccaactttaaaagaagttctatcatgagtaaaatgctaccaaattgcattgcatgctgcagataaatccaagtcaaaatcacaatgagatgctaactcaagccagtcagaatggctatttttaataagtcaaaaacaacagatgctggtgagattgtggagaaaaaggaacacttttacactgttggtgagagtttaaatttgttcaaccattgtgaaagacagtgtggtgattcctgaaagacctagaggcagaaatataatttttcccagcaatcccattactaggtgtatacccaaagtaacataaattgttctattataaagacacatgcatgcatatgttcgttgtggcaatattcacaatagcaaagacatggactcaacctaaatgcccatcaatgacagactggacaaagaaaatgtggtacatattctccttggaatactatgcatccctaaaaaagaatgagatcatatcctttgcagggacatggttggagttggaggctgttattcatagcaaaataatgcagaaacagataaccaaataccacatgtcctaacttatatgtgatagctaaataatgagaagatatggatacatggggggtaaaaacacacagtggggacttttggaggtcaggggatgcgaggagggagaggatcagaaagaatagctaatggattctaggcttaatacctgggtaatgggatgatctgtgcagcaaaccacgatggcacacgtttaccttgtaacaaacctggacatcctgcacatgtaccttgaactttaaataaaagttggaaatttttaaagaaggaaggtcaatgggtgcagcaaacattatttttgtctttttaaaagacattgccacagctccccaaactttcagcagccaccaccctgattagttagcagctgtcatcatcaatgcaagaccctccacctacaaaatgattacaactcactgcaggctcagatgattgttaggatttttaaagcaatgaagtattttcattacagtgtgtacattatttgtaacatatttatattgcagacttaagagactacagtatagtgtacacataacatctatatgccatggaaaaccagaaaattttgtttgacttactttacttcagtgttctgggaccaaatctgcaatatcttggaagtatgtcttgtataagtgaaaataaaatgagatctactcttttaaaagtattttaagtgtatgatacattattgttaactatggccacaatgttgtgcagcagtgctctgaaacctgctcatcttatttttactggaactttatactcattgaaaagcaactctcaatttcctccattctccagccactggtaacctccattctactctccgtttctttgagtttgactgtttcaaatttcttacacaagtagaatcatagagtatgtgtcccattgagactggcttatttcacttaaaattatttcctgaaggttcatctatgttgttacatattgcaggatgggtggatcatatggaagttctatttttaattttttgagcaacctctacactgttttcattttggctgtaaaaatttatattcacactgacagtgtatgaaagtttcaatttctccatttcctagccaacaacttttattgtgtgtgtatatatgtatgtgtgtgtttgtgtctgtatgttgataaagacatggtaagaggtatgaggtgatatctcattgcagttttgattttcctgatgatgaatttacattaattagttttcatacagctgttgtccatatgtacaacttcctcagagaaatgtctttttcaagtatttgcctatttattaatcatggctttttttctctttttgctattgagttgttgcagttcctaatatattttaggtgttaacctctcatgagatatatgatttgaaactgtttcccattcccattttatcttttcactctgttgacttctttgccctgcagaaactttttagtttgatacaattctactttcatatatttgaccttgttacctgtacttctgaggtcatacccaatagaccattgcccagcccaatgtcataaaactttttccgtgttttattgtgagagttttatagtttcagggcttatgtttaagtctttcatttgttttgtgttgatttttgtatatgacataaactaagggtccaattttattcttttgcatgtggacatctggtgttctcatgcagtaccgtttcttgaagagagtgacatttattgagtatatttgagactcattgaatataagtgcattgtatatttgtgactttatcatctgggctctctattctgttacttaaatctctctctatttatgtctttatgtgaatatcatgttattttaataactgtagcttttaatatattttgaaataaggagatgtgatgccctataactgtgttttacttttcccacattgttttggctagttacttcttcctggatcattatacattttaagatttttttgtctttgtataagtcattggtgtttcgatagagattacatttaatatgttaatcactttaggttgtatagatgtttctgtaacattaaatcttccggtcaatatactatgtctttctaaattagtataatctttaatttcattcatcagtgttttgtagtttttagtatacatgtctttcttccacttgttacagtttattcttatgtattttgtcctttttgaggccattgcaaattggagtgttttgttaatttccttttctgatagttctttgttaatacacagaaaggtaagtgatttttgtatgctgattttatatgctgcaaatttactgaatttatgcacttgttctaataatatttggtggcatctttagggttttccacatataatatcatgtcctctgcaaacagaggttattttactgttgattcagaagcctgttgctttttttctttttcttgcctaattgttccggctaggatttccagtatggtgtataatagaagcagcaagagtgaacatcctttccttattgtgaaaacagatgaaaagttttcagtttttttttaatcattgagtatgatgttagctatgagcttttcatatattgcctttatcaggttaagataatttccttctatttcttgttgcaggaagtcagggaccctgaatggagggactggctggagctgaggcagaacatcataaattgtgaagatttcatggacatttatctgttccaaaaattaatacttttataatttcttatgcctgtctttactgcaatctctgaacataaattgtgaagatttcatggacatttatcacttccctaataatactattataatttcttacgcttgtctttactttaatctcttagtcctgttgtcttcataagttgagaatgtatgtcacctcaggaccactattgtacaaattggttgtagaacatgtgtgtttgaacaatatgacatctgtttgtaaaacatatatgtttgaacaatatgaaatcagtgtaccctgaaaaacaacagaataacagcaattttcagggaacaagggaagataaccataaggtctgactgcctgaggggttgggcagaataagccatatgtttcttcttgcagaaagcctataaatggatgtgcaaggaggagaaataccgctgaattcttttcccagcaaggagtaaccctggggaaggaatgcattcctggggagaggtctatgaatggccactctgggagtgtctgtcttatgcggttgagaaaaggactgaaatatgccctggtctcctgcagtaccctcaggcttactaggattgggaaattccagcctggtaaattctagctagactagttctctgctctcaaaccctgtttcctgttaagatgtttataaaaacaatatgggaacagcaggacatagagcctcatcagtaattctaattctgcctttgccttgtgatctatatggccctttgaagcatgtgatccttgtgacctactccctgtttatacaccccctcctcttttaaaatccctaataaaaacttgctggttttgcagctcagggtcgtctgcacagtcctaccaatatgcgatgtcaaccctggaggcccagctgtaaaatttctctctttttactcttactctttatttctcagaccagtcaccaattagggaaaatagaaaagacctacattgaaatattgggggcttgttcccccgatatcatttctatttctagtttgtttagagctctcttttaaaaactcataaacaattgatttttttcaaatgctttgttttgcatttactgatatatcaagtgatttttatgcatcattgggttaaggtgatatgtcacatttgctcatttttgtgtgttctattatccttaaatctagggataaatttgtcatttcttttaggaaagaagcaatgctgagtcttgaacatagtaaaagccaagcaacactactggtcttgtaatatcaaaaggaagagtgagactttcttcacaatttaattattgagtagtttctttgcaacagtaaaaacaacaaaattctgctgaaaatgaaaccaaagaattctgagtatttgaaaaatggtattaatattgtgaacggatgtcttaatattgggtcaatgtataaagtgtgaaacacagctcagtaatttttgtgcatgtgccacttgtgaatagaataatgtatttcacataaacccatatggttttacattattttttatttttccttgtttttaagtatttgactaagaatatttctaacttttaaataggtactaaatctctggaaaataaattttgacctaacagtgtaagttataaaaatatgttttgtcacaggaggaaggaaatcctctgtatcaacctcttcatgctggaattaactgaaggaattctatcttttggtcattccagcttcaagccttttatgtaactaatcccttttctccttctttcctgttttagcaaactttcagaaagaaaacaggcaacatcttgtgatgatgaagatcacagttgacacataggccagcaggaacctaatcacatgcaagttgtggtattggaaccaggtgaggtcgtgggctgcaacccgaaggtgcttggctcctttgtgctgcatgacaaactcaatccagaaggctgcttgatccaggggcttaattggcaaatcatggcgaattattgataacttcatagcattctctttgtagctgaaggataaacataaaaataccaacattgaaagtaaatttatttcctaagtctatggatggtctttgaaaagtgtcacatcaatgcttcaaagtaaatattatagaattgtcataggaatcgaatgttttggtttggacaaatgtagaaagtttattttttaaaatggaattttataaagaaaaatatgtcttaaattaaaaatggaaggtctgatgagaaagttaatgtctttgtagcagaggaaatattttgagccattctatgtgctacaggtaagacagtggaaatgcaatctgagattgatcatcttgatattttattttatttttttttgagaaagagtctttctctacggcccagattggagtgcagtggcatgattatgggtcacagcagcctccacagtgtgggcttaaacaatcctcccacctctgcctcctgagtagctgggactgcaggcatgcaccactttgcccagtaatttttaaatatttttttgtagagatggagtcctaccagtttgcccaggatggtttcaaactcttgggctcaagtgatccttttgctttagccttccaaatttctgggactacaggtgtgaactacctttatcgacccattttgatatttttaaggaaaaattgtttcacagctggtgtaatatttctaaattagtctttctctttctaccctactattctgtgttctaccatattttcctctcagtagtcagaataattttttgaaataaaagccagattatggcattcctctgataagattttcacctggcttctcactatattaagaataaaatctaaatctgtctttgttctacagaaccctacatggtcaggcatgggcaacttcttctaacactttccccaaccaccttctctcctagaggcattgcccttctattgttctttgagctccccaatgtgttctcacctgagcccctttacaccctttatcccctctctccctctcttggaatattcctccttgcaacaacttgaggcttgcttctatatctttttgaggcttccccttaaataatacctgttaaagaggcttttcgtggccacactatggtagtacctgtaggatttcctctattgttttgtgcttattttgctgtttaactcctggaacttaaaaatatgttacatgtcttctcaaataaaactttaagtataaaatacataaatgtacacaaattcagtgaatagctcaaaattttaacattaccttgaacaatatcctgatgtgaacaccaacttacctactacgcagattataatataagacatcacaacctgcctagaaaaactctgtcttcttgggccattttagtcactacttttgtcctcaagttaaaactaccttgacttctaatagattaatattgcttgtttacataatgaattatataatatatactcatttgtgtctttttttgggtagaagttattggctaattccattgctgtaatatgattcagtcaattgacaaataccacagattatctcctatttttatgactgatggatatttgggttgttaagatttttgaacactattactaattctggggtaagcaaatgtgtgtatatcattagatatacatattaatacatttttgatgggtatatacttgagagatgagttgctgagaaaaagatgcatgtagaattatgatgttttgttgactagctttttaaatacacaaatttaatttccaaaatttagagttgttttttaagttataattttttggataatttcgaatttatttctagtatggctagagcatttcctttttatgcttttgaatcttatcacatttgctaagtcctgatttttggcccagcagaagttcaattcactaactattccatatactcttaataaacgtatattctcaatatacattcacactcacctccacacctccacacataaaaatgtgtgtgtatatatatatatatacacacatatacacaaacttactatatatatacacaatacatatatatgtatacacacacatatatacaataggttatatttatgctcttcaaatgtttatttttaagtcacttttttttctctgtttaaatttagtatgagttctagtagattcacttttaaatctactatcttattctgtattttattttctgttttccaatctgctgtatgtttcttttctaattctttcctgtttgcttttaaactatttttaatcattcactgtcttattatcttcctggtaaggtattttcagtatattttctaagatggtacctccttatatatattgacaatagtaatcaatagtcacagcattttctacattatttcttttggagcacagaaaaattattacagatttattttctcaatattaaaactttgtgcttcaagggacatcttcaataaagtaaaaaaaaagaatcaacctataaagagtgggagaaaatatttaaaaatcatagactgacaaggcattccaccaataatataaaaataattcttatgaatcaataataagataaaaatgttagaaatgttcaaaagataggaataaaattttctcaaaagaagacgaatgacttgccagtaagtgcatgaaaagatggttatgtctttagccacaaggaaaatgcaaattaaatccacaatgaaagatcattttatatccactgggatccctgtaacaaaaagataggagataacaagtgtagggaagagcatgaagaaattggaaccctcctgtacagctagaagtaacgaaaaacggtgcaagtactttgaaaaacagtttagcagttcttcataaacatcaactttccatatggctcagaaattccactcctagtatcttctcaaaattagtgaaaacaacttttttcacaaaaaatatgtatagcagtgtttataagagctaaaattggaaataactgaaatgtctgaaagctgataaatgggtaaattcaaaatggtacattcatcaaagaatattagcaataaaaagaaaaaatgttctgacactttcaacaatatgggtgaaactaataaaagacattgtactaagtcaaagaaatcatttatagaacactgtaaattgtatgatttaatttacatgaaatatccagagagaataatctattgagaaagtaagttgatatttccctaggactggaggtttatcaacagtgattttatgcattttgaggtttattttagggtgataaaaatgttcaaaaattatattatggtgatggctttgtaactatgtaaatgtactaactacttttagatctcacttttaaataggtaaatattatgctatgcaaattgtatcttaaaataatgataatactaaaaatacattattgagcatgaatacagttatactttcagaaattttatgtattgaattgaaatactttattttatttctccaagttcattatttcattgtattataatccatcattcaaaaaacttatattttaaacaattatctatatatgtttaaaaatatttgtgtgtagaaggttgttacagtaattggtgacccattaaatatatgggatcaaatgtaactaaaataattggtgaaaaataaaagcaggtttcaagttggttaaattatttaaattctttcaaaattggtctcctaaaaggggtaagacatgtattcagtgttgtcaaaagaatctgtaaataccacatagtaaaaaaaattgtcatactcacacagggtcattaatgactgtcttcagtgcattgagcaaatctgtacttgacatggtcctgatgtccacattgagggccttcatgtgagcaatgttatcaggttgatctgcaaacaaaggaatgcccaccatagggatcccatggtagattgcctcatagatgccactggtttcaccatgagtcataaaagatttagtttttggatgacctaggattggataaattttagcaaaattattcataagactaaaatgagaaatgcacaatagaatgctctgaaaggggcagtgtctactaaataacagattattatacacatcaaactccattagaattgctttcggatttcagagaaagaagcacctaattcttctggaggtaagtgaaggctacatgaagaggtgggggcgtgtgtgacttcagactcaaaaaatgaattgatattgccaggtggacaaaatgaaaaagcacattctgaatgaaaaaaatgtgcaaaaaaaaagagaaaagaaaatcaataatattgtgtatgttagagcattttcccttaaatacatactgcggtctgagtgggatatgtggtgtatgcaaggcaacagggagtgtggtggtggtattggaatagaagaaaggcaggccacattacatcaggaaacgtgttatcactttatgataaagattgaggatttaggccgggtgcggaggctcatgcctataatcccagcactttgagaggcagaggtgggtggatcacctgaggtcaggagttcgagaccagcctggccaacatggtgaaacctggtctctactaaaaatacaaaaattagagaggcttggtggcaggtgcctgtaatcccagctactcgggaagctgaggcaggagaatcgcttgaacctgggaggtgaaggttgcagtgagccaaggtcatgccaatgcactccagcctggggacaagagtgagacttcatctcaaaaaaaaaaaaagattgaggatttattttcagaaaatgcagagttattggtaataaaagaggcactgttattttttagtgtcttttgaaattaaccctgaagtagggaaaaggacaggtgtaaagctgtacaaataggagacagagagacaatccaggaagttattgggaaaccccgtgagaggtaattatatctgaaataaagataatttgattctgaacataaagaatgtgagtgtctataataaaataccaactatatagttattttcctggtaagactggaaaataaatataaagtagttagcctttatatttgagttttttgataataaatgttccgtaagtttctttcaggttgaactatccttctaattagctgttagtcatatattcagtatttgttctgcagagtattaccaagaaggtcattctgggatatccacttgtacagctgagtattggatgctaaagtatttggtctctttccatccacagaacctgttggggtaaagaaaatatcttgttccatgagtagaatgccaaagctataagatgttagaactctaaagaaattgtcaatcaactagttaaaccccttccatataatagatgaaaaaacgagaacaagcaattttaggaaatgagtactactaaaagactattgaatatccacatttcatgtcttttattatcaatttggtatattagaaaatcatgatgttttcaacagagaagcttagacacttgagagtatcaataaaaaattcaaaaatttaagaaattattagacagtcattataattctactgtaaaatacagtaacaaattagtgacaacctatacatttattttatgtattttatactacctgtaatcttccaaatttaatgttagtttatttcttgagtgaaatgagaagtgttacttatatatatttttctgtaagttattttgttagtgtttgacatctttgatttataaaaaacaaaatctataaaatcagctacctgtgagaaataaatcagtgctacataggtagtacatataacttcttgtagattacacattacccagcactacatccaagaaaaatttcaagtgacaatttctttcttttcttttcttttttcttttctttctttctttttttttttttttgagatggagtcttgctctgttgcccaggctggagtgcagtggcaccatctcagctcactgcaaccctcgcctcctgggttcaagcgatttttctgcctcagcctcccaagtagctgggattacaggcatgcactgccatgcccagctaatttttatattttttagtagagacggggtttcaccatgttggccgggctggtctcgaactcctgacctcaagtgatctgcccacctaggcatcccaaagtgcaagtggcaatttctgagtcaaattcaaagtactatcattttgctagttttggaaattcttccaatgtaggcgaaaagagccaattggcaatttatgaataagaatatacacactaaaaattgtaaaattatattttgctaaattttgcttaactgatcattaacacttagatgctgctataaagcatcgacagcatagattaatatgggctgctttagccaagccatacccatagacagtaccaaaataagatactgattttagattccccaagcaatccttataaactggagtgtaatttacaagtgttttccttgtatttgctatgtgagtgttaaagtaactttgtgtttccagaaaaaaattagcataggtcattaggagaaggctatgtcagagaggaaactaaaaagtaactcacaaatacacaaagacttcaagtgtattctgcatactacaaaataagttcctactatatttcatggagtgagggcatctgaacctctttccatgtctggcttccttctgcttgactccttcttatattcccttctccttcctccgttgggaggaggtgtttttctgatggttagagcagaggctttatgggaccacattttataatgcacggagtctaccctaaaagcaggattctgttccctccttttctatcatattttcctgtttaagacattagcaaggcccagtaaacagggcaggcaagttcttctgcttctctaaatctacttggctaggtggatacctccagaatagcggtttgtcagcctggacatcttttctctgaatgcattctgaattgcctactaaataggtctattccaaaatgtacaggaagtacaggagaccagattacctagcaagcctaaattgaatgatgcatttcagacttttttcaataccttattgttattgtaatagtgcagtaactgattaaaatgtaagtgattttaaataatatctatagtgtataccatgttctcaggaaacttgtaagcaaaagggacaaatgacagggcagaatttggtgatttctatgtacatgcctacaatactatgataataccacaacttcacctgcacctcttaaatatattttttctgatcacaatattaatgtcagaatttttatcaatcaaacacaccctcgttattttagtatcttccatatatatttttgtttttgaaccaatatctgagataattagagctatcatatcagttagtttttctggcagaaaatttctgtgattggactctttacagagtttaacagactcattcagtagctgtccaccattaagacattttatctaacctttcgtggaatctgggcaagagctgatgcaatcacgttggccctttcttctgtgatgttactgaccatagacttaagcaagactgccacgacaccattttctccagagctctgcacaaactcttccattttctgtgaagaatttgttctatcacaaaagagtgtcagcatagcaaacactatagaaaagattagtacatacatctaagaagagaaaatcaagcattatcagaaatttttggagtaatggctattttttaactgacctaatctctttctttggaagaagttatggaatatgatatacatggcatctgttatggctatttgtgtaaatatgtgtgtctgtaaaaggaaaagatgaaaaacaactatgacactatagaagaaggagacaatgctagaaaatattatacccagactcttcatttacaatactgtaattactaatatgggttcttggaaggtggcatttgttgtgtttaattccatatgttgtagttctactaaattccttgtgtctattaaggcagggttttttgtttgtttgtttgtttgttctttctgtagagtatttttagttgggagtcattggaaccattacctggctatgagcagtgaggaaaagttactattgaaataattttatatgtctatttctttagctctgtaattctttatacctcatttaaaacttgtcagattatgtctttttccctaaaaaaaaatctttaaaagctgaagtttaataatgatggagattcaagagtctgatactgtggtgtgaaatttctgtgaactagtcctgagaatcccatttataatacagaattatgcagtatatagttacataactgagtgattgtatttctcaggtcattgtttaaatattactaagacactttttttcctgaaatcacactgcataaaatgatatgctactggccaggcatggtggctcacacctgtaatcctagcactttgggaggtcgagatgggcagatcaccaggtcaagagattgggaccatcctggccaacatggtgaaactctgtctctactaaaaatacaaaaattagctgggcgtggtggcacacacctgtaatcccagatactcgggaggctgcggcaggagaattgcttgaacccgggaggtggaggttgcagtgagccgagattgtgccgctgcactccagcctgggcgacccagcgagactccatctcaaaacaaaacaaaacaaaacaaacaaaccaaacaaacaactgatgtgctacctataactgcctgtgagggaccctcatcatcacttttctgtgtctcacaggggcacttaatcctcagtggaagaatctaccagtcatttttccagtggagatctcttcactatcttgagtagctcattcacacaatataaagcccttgttgaatatgtgtttgcttgaaatttattgagaattactctgaattgtggtttcccttatgttctcatttgtaaatgtaaatgcatagtgtaattccacattgctcagtgcatacgcctatcaagacaaaataaagagaaagagaaatgtagcgccaaaagttttcagtatataatgtcaaaattgaatacccatctttttgttgttgttgtttcttttgttttccatttattatttatttattttctctgtaaaataatgatgaacccattctgacataaccggtatactttcagatcctaaacatgggaggtaaactttcttttaaaaacttgtttaaaaaaagaaatcctaaagtttgtgtatgcacaacatattttgccaagtatttttcaaaaatataatttgagccttatgacattagttttaattggagagtcactgtactactattccaggtagttcttggggctcccaggtattctgtgtgactcgttacctgtgtgaacacaaagtatctgaaacagttctcaatttagaaagtttattttgccaaggataaggacatgctcatgacactgcctcagaaagtctcaatgacacgtgctcaaggtggttggggcacagcttggttttacacattttagcagacatgagacatcaatcaatatgcgtatgacgtacattggtttggtcaggaaaggtggggcaattcaaagtgatgccttcatgtcatagataagagttaaaaggttgcattcttttttgggtcttagatgagccttttgctgaatacacagtatacatatgagagaagggttgagaaatagtcacttatgccttagtctgactcagtaaatctgcattttttccataaacaatggtgaagggatggctttgagttctgtcctcttttgtccctcacctgtgaagataagctatcaatttacatttccagggtgaaattcaacagaaatgtttcaggttaaagattttgaggcccacaaggaatttcctcttgggaagattgtaagggaggtatgtaacttaaaaacaacaacaacaacaacaacaacaaaaacccaactttgtagctattttatttaggaataaaatgggaggcaggtttggctgatacagtttccagcttgacttccctttgacttagtgactttgggttttcaagattatttttctttcagacctgtagccacatttaatggaacttgtgtttgatgttttttctcaatgcctcgctgcccagagtcttcttcatccacccaatattgaggtagcatattgtctgtttatacactcatcagtgatctcattctgggatatcttcatgaaaataatatatcagtgtacaaaatattagagtatgaaaagcttaaaaaaattaaatttccctcatactctctgtctagagctattcctgatttaaatttgtatgcttttattatggtttttattctatttatataattcactgtgatgtttatttagataattttaatcttattgtatattccttttcatcctgcataaaaattgtgatctagttctattcatcattttgtttctcagtttccgacaattcttgtattatagctgacactgtaattatacatattttgataaaatgattgtaatggcatagaatgcatattgtatacatttttacatagtacccaatagtttttcaggccttctgcccttctcttccctctgtagtagtccccactgtctattgttcccatttttgtctatgtgtgccccaagcttagctcccacttttaagtgagaacacatagtatttagttttctgtttctgggttaattattctggttcatgtgtgtgtgtgtgtgcacaaatctccatgtatttgtttgtttatcttggctttaatctgtcattttattttcttttttcaaatgttgtctgcctatctatctatatatttatctatctaatctatctatctatctatctattatctatttatcatctatctatatatttaagaatgaggacatagaatgattcactgggatatctttgtatctgtgaaggacttagtatctggttggctttgatttttatgctgaacgcgtacaactactagaccttacctaaagggaaccaaaaatttcataaaaaagattatactttgatgtgttacatcaattctagttttctcattttaccctggtgaatttatttcaatttctttaaggaaaaactctctagtttttgtgtggaaagtgcaaagaggaacgtattatgtaatacagtaagggttagtgcatttcattttcatgtctttagtttcctttagtctgtaattatcccttcattttttgtctctgttaatttttgacttctagatgaattattgaccagttgttttgtagaatgattcttattttacatttgtttaatgttccttcatgattaagttgctatcacacattttttgaaagaatactgcagacatgttgttgtagtcttcacattacatcatttttgggcagcagatagtgttgatttgtcatgctggtgatactaactttgatttcttggttaagatgctgtctacaggtttattccctgtaaaattataatttctcattttggaattagaagtatcttgataggagactttgagactgtaaatatcctgtttccattacatcctttccctctaattttagcatccattcaaagataatttttgcctgaattaaattactgtggagtttgtctaatgattatttctatgtctataatttctttaacaattagtaagagaaattctactctaagaaagaacattttttcccttttatttccttatactggtttctgtcaatatgatttcatgagtatttggtttattccaaaggttacaatccacagctatcattattccattgctcaaattggtccagattcgattcattgggacttccttcagtttccttctatatttttctgatatgttgtcatcatgttgtatacttatttactttctggcacccctagatatttcaggcacatcctgtacttttgttgcctcaggggtaatgtcatttatatcttgaggaaggcatggttcgttttattggagtatagtgtctagaagcaaaatttcaagtacttagcatgttcattgcatctgggatattattacttctaggccatttacgcatagacattttggaaatgtatctatgcataacttttcattaacagcttaagagaataaataaattatcatttccataaaatacagaaaaaggagagtgtagtaagctaaaacatggtaaatctaaatagtaaatatttacagataagctcaaactaataatttaatgtaaaaagttattttcatttaatgtcatgtaatagttatatatcaatttaaaaaagaattaaataaactcacccattatggtagagattctcagatatttcaatctagcttttatttttgtttaaaagagaaacacctaataaaaattacccatattactataaaatatatacagattttacaagaggcatatacccaatagcaaataaatgaaaattgatgcaatgctacaaaaatcaaacaaagcagaattaagatgcgaagtatcaaatgtgataagtgaatcatttcatgtggatagaaataattcacttaaaattaacaataataagtatttggagattgaaatatatctcagaaactgatagattgaacagagaaaataaattctatgaaagttgattgtattagcaacaaaagtaacaaaaataacgtactgaatcctgcatcttcaaatagagtataaatattcttttgaagtgcacatgaaaacttttataaaattaaactaaggcaatgtcacagatgaaatctccacaaattctgaagtatatatatcatatgtatctatataatgtgatacaattaaaataattataaacttaaagagaatgtattacctttcaaatatacacatttaagaatttcattcagtggagtggactgtgcttaccattcatgacccaagtctttactaccttttctgctccaaacacatataccatgaagagaagacggcatagaatatactcaggtaagtatacaactgagaaaacttacacaccagttgttagcattagagaaaattatatgaatagattcttataggagctataacaagatggttttggcaggataaaaaatgtggcaaaagccttaaaagtggaaaacaaaatttacctacggagttcagggaatttctgttctgaaaaaatgtaagttgtaataactaaaaaattaaaacaaattataatgaaactgatctctctagatgacagcagacacatgcaggaaatgaaagtttgcagaaattaacagctgttgaagattaactcatgaaaaccacatgaggaaataaccaattctacacaatagtaagattttcacccaaagtttataaatataggaaaaaatcaaaataattttttttctcagagatgagaaaatacttaacataaaaatggaattgggtgagaagcatgaatagaaagaggaacatttagaaattgtggaaattagaaatacagtcactgattgtataaaatgtaatagagttcacaaaataaaatggaaccgaatgaacgaataaaagaatgaacaaaacctgcaataaggtgaattagtaaactttctctttttctgactgaaccttgactgatagagcttccaacagaaatcacctaatactgtaggaattgccattaagctgattaaaatatgaaagtgttatttgctattaccacatgttagagccctcctgattgcctgctttacttctgaagctctgtcattatggtttcctggttttaatcactcattctatgcttcactgaaatattttgaactgattcaatgtgtttctctcaaatttaattttattctatcctgtctcttgcctcctgcaggttctcactgtgagcaatccagctccagagcttaccttctctgacctagggttcctcatttttttttttttaccagtttatctgaacttcattgatcttgttcctttgccaatcactctgagccactgtcatcatgactcaggattctagaatttgaacaaattataaatttgccctttgtatcttctgtatcccaaagaagaaccagtagacggtaccacaagagaaaaatgagtgcagtacatgaacaaaacacctgaatgaatcacaaacaaaaagagatggttgattagatttataattaagcatttgccaatcaaatcagtgattcatttttatattatttggattggtaaaatttaacatccaccatagatgaagcacgaaataactgtccactccagtgctgcataggtgggtgtacatagagggaggtagtgtttgaaggatacccctgggctcaactgactcaagctagctcagtcttggtaagagggagactggacacttctggtacagttgggctgcagacacactgtaccaactgtaagttcactttggtgagaatcttcatatgccctcacttgaaagaattttcttttccagataagtttatgccttttattcatccgaattttaccatgatgctgtgctcaaagatacaacaacatttgaggcactaaaaaatgaaaaattttaaatattgttgtctgctctaacagttttcaatttactgaaggtggaaattttacagttattaagaaataaagtaaactgaaaaaacataggtggagtgagactgagagaaaaagaaatggagagagtcatggaactcttcccagcagggtgaaaattattggatatttattaagaaaagggatgaatgaaatgaaaattaacatggctaaaaaaaggtctcaacacaacattatgagaggtaaggtggtcaaatgagactttttgaaattaatccaacctaaaagggccccaaactaatcagtttcatttatcgcagtgtggagtagtttaaaaagcaggaatgcagagatcacagttagaaagctgcttaataatttcttcagataatgctgaggcagattaatcaagataaaaattaacacacaaaaaaagggtttattggtttaaggccctgctgttgacccaaagccttgtgtaagactgtcaggggatagggaacagaaattccagagactccttaatacaagaccccatgtgatatgctaccaagatgcattggggaagccttgaccgaggttatagttaggttgagaaaccataaaaatataaagattaatagaattatgaaatttgtgatatttaaacaggcttaatttaaagaaagtgtgtctttttaacttaaatgtcttatgaaatggactttatgtctggctggaaacacttgttctgcctattgataatattgtaacacaaaacctgctgataaagtcctaaaggagcttaagtaaaggttaatgaaatgaaaaggaaaatgtataggaaagttggtatttttgaacatactttatgtgaagtagtatctattttatctgaatgtgtcaaggttgaaggacactgtatctaactaggaaatgtttcttgaatctaatattgtataacagaaggtatgcaaatttgcccttcagccaacattaattggacatgctaaatgaaaaccactatggtagggtggagtcaagatggccgaataggaatagctccagtctacagctcccagcatgagcgacacagaagacgaatgatttctgcatttccaactgaggtaccaggtgtatctcgctgaggattgttggacagtgggtgcaggacagtgggtgcagtgcactgagcatgagccaaagcagggcgaggcatctcctcatctgggaagtgcaaggggtcagggaattccttttactaaccaaggaaagggtgacagatggcacctggaaaatctggtcacttccaccctaatactgtgcttttccgatggtcttagcaaatggcacaccaggaggttatatcccacacctggctcagaaggtcctacacccacggagtctcgctcattgctagcaaagcagtctgagatcaaactgcaaggtggcagcgaggctgggggaggggctcccacaattgccttttgtttggctatgccctgaccccagaggtggactctacagaggcaggcaggcctccttgagctgtggtgggctccacccagttcgaacttcccagccactttgtttactcaaaaccgctcaactatatggaaactgaacaacctgctcctgaatgactactgggtacataacaaagtgaaggcagaaataaagatgttctttgaaaccaatgagaacaaagacacaacataccagaatctctgggacacattcaaagcagtgtgtagagggaaatttgtagcactatataccctcaaaagaaagcaggaaagatctaaaactgacaacctaacatcataattaaaagaactagagaagcaagagcaaacacattcaaaagctagcagaaggcaaaaataactaagatcagaatggagctgaaggagatagagacacaaaaaacccttcaaaaaatcaatgaatccaggaactggttttatgaaagaatcaacaaaattaggagactgctagcaagactaataaagaagaaaagggagaagaatcaaatagatacaataaaaaatgataaaggggatatcaccaccgatcccacagaaatacaaactgccatcagagaatactataaacacctctatgcaaataaactagaaaatctggaagaaatagataaattcctcgacacaaacactctcccaagactaaaccaggaagaagttgaatgtcttaataggccaataagaggctctgaaattgaggcaataattaatagcttaccaaccaaaaaaagtccaggatcagacggattcacagcaaggacttcatgtctaaaacaccaaaagcaatggcaacaaaagccaaaattgacaaatgggatcttattaaactaaagagcttctgcacagcaaaagaaactaccgtcggagtgaacaggcaacctacagaatgggagaaaatttttgcattctacttatctgacaaagggctaatatccagaatctacaatgaactcaaacaaatttacaagaaaaaaacaaccccatcaaaaagtgggcgaaggatatgaacagacacttctcaaaagaagacatttatgcagccaacagacacatgaaaaaatgctcatcatcactggccatcagagaaatgcaaatcaaaaccacaatgagataccatctcacaccagttagaatggcaatcattaaaaattcaggaaacaacaggtgctgaagagggtgtggagaaataggaacacttttacactgttggtgggactgtaaactagttcaaccattgtggaagtcagtgtggtgattcctcagggttctagaactaggaataccatttgacccagccatcccattactgggtatatacccaaagaactttgaaacatgctgctataaagacacatgcacatgtctgtttatagtggcactattcacaatagcaaagacttggaaccaacccaaatgtccaataatgatagattggattaagaaaatgtgtcacatatacaccatggaatactatgcagccataaaaaatgatgagttcctgtcctttgtagggacatggatgaagctggaaaccatcattctcagcaagctatcacaaggaaaaaaaaccaaacaccgcatgttctcactcataggtgggaatagaacaatgagaacacatggacacaggaaggggaacatcacacactggggcctgttgtggggtgggggcagtggggagggatagcattaggagatatacctaatgttaaatgatgagttaatgggtgcagcacactaacatgacacatgtatacatatgtaacaaacctgcacattgtgtacatgtaccctaaaacttcaagaataaaaaaaaaagagtttttcaggatgatggtccatcctgaagtacataggaaaaaaaaaaaaaaggaaaccactatggtattccaagttcatacaatgtagaatagaagctggagtgttagtacagaaagcattatctgttcgatagcccggataaacaacttcaggaaagtttcaggatgcaaaatcaatgtgcaagaatcactagcagtcctatataccaacaaaatccaagtcaagagccaaatcaggaacacaatcccattcacaactgccacaaaaaataaaataaaatgtctagaaatacagtttaccagggatgtaaaatatctttacaaggatcactacaaaccactgctcaagaaatcagagatgatacaaacaaatggaaaaaaaatccatgctcatgggtaggaagaatcagtatcattaaaatggttatactgcccaaagcaatttgtagatttcatgctattcttatcaaactgtcaatgacatttttcaaagaattagaaaaatgtattttaaaattcatatggaaccaaaaataaaaagcccaaatagccaaggcaattgtaagcaaaaagaatgaagctggaggtatcatattacctgatttcaaactatgctacagggccacagtaaccaaaacagcatgatactagtataaaaacagatacgtggatcaatgggacagaatagagaactcagaaataaggtcgcatacctacaactgtctgatctttaacaaagctgacaaaaaaaatggggaaaggacaccctatttaataaatggtgttgggataactggctagccctacgcagaagattgaaactggaccccttccttacacaatatacaaaaattaactcaagatggactaaagacttaaatgtaaaactcaacactataaaaaccgtggaagacaacctaggcaataccattttgtgcataggaacttgtaaagatttcatgataaaaacaccaaaagcaactgcaacaaaagaaaataaaaatgacaaacagtatctaagtaaacttaagagtttctgcatagcaaaataaaatattaacagagtaaacaaacatactaaagaatgggagaaaatttttgcaaactatgcatctgacaaaggtctaatatctagcatctacaaggaactaaaacacattttcaagaaaaaaaacattaaaaagtgagcaaaggtcatgaacagacacttttcaaaggaagtcatacatgcaaccaacaatcacatgaaaaaaagctcaacataactgatcattagatgtagatgatgggttgatgggtgcagcaaaccatcacagcacgtatatacctacgtaacaaaccggcatgttcttcacatgtgtcccagaacttgaagtataataaaaaagttaattaattaaaaaaagaaaaatgtaaatcaaaaccacaatgagataccatctcacaccagagtggctgttcttaaaaagtcaaaaaattaccgatgttgatgaagtcgtggaggaaaggaaacacttgtacactctaagagtgtaaattagttcaatcaagaccagactaaatatagatatgcatccagaaatgcttttagaaaatatatcatatgtttataatacataagctaataaaatgggagagttctctgattcccctggcaggatgtgtgacaggggtgtggctcacctgtttggtcacccggcagctcaaacccctaaggcagatgggcaggtgcagaggccaggcaggtgcagaggccagggcagagcgttttggactctcagccccatggcagcgtctagggctgggtgcctacaaccacagtgttactaagctctgtcagctttgccatctgcaggcggcttgtgtgttagttagcccaataaaccctctgccttatctcaagggcagaaggccagtgtgacagtcttatgtatcctgagttcttgcccagtgtcccaaaagaatcggatcacacgtgagcgtgaaggattgaatgcaaggttttgttgttgttgttgttgttgttgttttctttcgttttgtttttgttttttagagacggagcctcactctgtagcccaagctggagtgcagtggcgccgtcttggctcactgcaaccttcacctctggggctcaagagtgaatgcaaggttttattgagtggtgcaggtggctctcagcgagatggataggtagcagaaggagggatagactgggaaggtggtcttcccctgcagtcgggctgcccagaggcaggactctgctctgaccgccgccagctccccaccaccccacctctccgctgaactatcctaagcatctagagaggtccctcctcttctctatttctctgccacatcgttctgccgttgctagtctgcttgtcggctggtcgtctggccttgatgttcagctgcttgtgtgtgtgcctgctaaggtctcaggtttatgtgggcacagaatggggggcgtggtaagccagagaggtcttggaaaatgcaacattcaggctcaaaaacaggagtgcctgttctcaattaggtctgtgggcacatgcccgagggtgaatccctcaccagtgaccttgctcttctctaccccacacttcgctgcccaatctccagttccactaatatatctaaaagtcacatgggatccctccagtctagattattggtgagactactgaaagcttcaggtacaactttaacatctgcttaccttgtttttttttctcttaaacagctttagtaatgtataattgatgtactataaattctacctatttaaagtgtacagttgataagttttgacatgtaaacattcatgaaaccattactacaatcaagataataatagatcaattgccgcaacagttttatcatgttcctttgtaattgtcttatacttctccccagtctcctatagccaggtaaccattcatctgttttctgttaatagagctttgcttgcatgttatagagtttcatataaatggaaccacagtctgtatacttgtttcactagcatctttcactcagcatcattatttttattttgagatttatttactcttcatgtaccaatggttcattccttcatagtgcggagaaatacctcattgtatagatatgctacaatttttttattcattctctgttgatggacatttaaattgtttccaatttgaggtcattgcaaataaaattacgatgaacatttgtgtaaaatctttaaatggatatgtgttttcatttctcttggctaaatacctagaagtaaattggctagatcacagggtaagtggatgtttaactttttaggaaactatcaaactgttttccaaactgattttaccattttatttccaccagcagcgatggagagttctggttgctttatattcttgccaacatttgatatgacctgtctctttaatttcagcctttctaatatgtgcatagtacttcattctggttttagattgcctttccctaataactaataataataagcatcttttcatgtatttactgaccatctgtatcttctttggtgacatgtcttatccaacattttaattactttgttttattatttatcgagttttaagagttatttatatgtgttctatgtatcttttagcagatatatgttttgtaaaatattttttatttcaatagctttcggggtacaagtggtttttggttatatgtattaattgtatattagttaattctgagattttattgcaaccatcacccaagtagtgcatgttgaacccaataggtagtatttatcccacaccccattcctaccctctcctttctgagtctctaaagcccattatattactttatatacctttccgtactcacagcttagctctcacttacaagcgagaacatacgttgtttggctttccattcctgagtgatttcacttggaataatggcctccagctccatttaagttgccgcaaaagacattattttgttccttctcatggctgagtagtatttaatgatttatatatacacctcattttatttatctactctttggtcagtgtagacttaggttagttccatatctttacaattgttaattggattgcaataaacatatgtgtgcatgttttttttttcttcatataatgactctttttttggtggggggatagatacacagtaatggcattgctgtattgaatggtagatctacttttcatttctttttttttgagatggagttttgttcttattgcccaggctgaggtgcagtggcgtgatctcggatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctgaagttgttctgcttacttttgagtaatatcggtagctgacattttctgagtactgactgtgcccaatctgctctgtgtgctgcctatattttacctcacttaattcttatcacagtcttataagggatttttttttttttttttgagacagagtatgccctatgtggcccaggctggagtgcagtggtgcgatcttggctcactgcaacctctgtttcctgggttcaagcaattctccttcctcagcctcccgagtagctaggactataggcaagcaccaccatgcctggctaatttttgtatttttagtaaagatgggtttttgccatgttggccaggctggtctcgaactcctgacctcaagtgatctgcccacctcagcctcccaaagtgctggaattacaggcatgagccacagcgcctgacttgttatctttattaggaacaaagtttcttctgagtaaacatttagtctttttgttgttgttgttgttgttgttgttgagacagggtctcgctctgttgtctaggctggagtgcagtggcatgatatcggctcactacaatctcctcctcctgggttcaagcattcttctgcctcatcctcccaagtagctgagattacaggtgcgcggcaccatgcctggctaattttttgttgttttagtagagatggggtttcactatgttggccaggctggtctcaaactcctggccttaagtgatccgcctacctcggcctcccaaggtggtgggattacagttgtgagccatcacgccggcttcttggtggcatcttgatacagggtgtgctggatatctgtggccaccctgatcaattttccaccttgctctattccttaagaatctcattcatagggactacacaataatcgtttatcttctctcagttttggttgagttcaggcatttgaagataggaagaaagtaagggttttgaactatttattttcatggctccctctatgtagggttaacatagggtagctctgtctctctatctatgacctcaattccttttcaaccctatctatacatctattctatctgggctctagtaactctgccttccacttgcccatccaggcccagggtagtgctatggaatgaactcccatccacccccaaattcatatgttgaagccctattccccaatatgactatattcgaaaataagaccttaaggaggttattaaacttaaatgagttcataagggtgtggtcctgatccagttgggttaatgtacttattaaaagagacaccagagagcttgctttctcttctcattcaggcaccaaggaagggccatgtgaggacaaagcagctgtctgtaagccaggaagggagccctcaccagatattgtaccctgttagaacgaaccttgatcttggactgtccagtctctaaaactgtaagaaaattaacttctgttgtttaagccatccagtctgtggtattttgttatggaagcccaggctgactaattgggatagtaaggcactatcttgtatagtttcttaacactctgcccgcacttttgtaaagagtccctttattaaactccccctaattggcattcatgctgttttctgataggatcctgattcatacaaagcagacaatcagagaacattacccaagctaagaagagtgactgacccaaatgttctccttctctcctggaacttgaaggcataataagagtgcatcttatttctcttggtagttaggcttcagtttctgtttctgttttgaagtgtatgagactgctgtaactcatgctctgttcttttggcccagccaatgtatggcagtttcttataaggatcacaacccaccatctcctcaggctgaccagattcttcacttcagctcttgctggtactgtggatttttcaagactcacttatgtgcatactccatttgaccctagcactggcctttgcagtggtgactccttggagaaaaactcactcagtccatggttaacttgcacacacctccagagttacatgggcatttctagttctcttcacatcttgggaaaccaagagacaatctcctaggctccccctgcttaaacatgctacttaaccattttaactctactgtggccttcacattggctctaggcactctgcttccaaaattccaaacaggaagtggggtgcaaatcctatgtactttcacttaatgtctctgtagacattcagaagcacatttccacccaatttccctctgaccctcttcttggacaaagtttttgtgataccactttgatgataaagaatctagtgaggccttaagatacaacctaagaaagaaggtcaaaaactgcaaagtagaaagaacatttagatttctacaacttttgcaatttcttgtgtatgtgacgtttgtctccttataccacagagattaccaaaacaggcaccagaggaaaaaaaagatgatcaccaccaccaccaccaccatttaataaataatgtgtttagcataacttcaggatgagaaaagaagattagagctggtgggacagtgattctaagacttctcagaggtgatttccaggatgactactccaaagagaagaggcaagtaaactgcagtcctcaggacctgttgctaagaagaaaagaaattctgaagaatcaattcagatctgaaaatattggactgggtcgaaacacacttgaaaatataatctgtcatacattttctcattgcttaggagtatgggcttgggcataaataagattagcattttagcaaacatttactgcttagaagctatgtgaacgtggagaagtgtaacacagaggtgaagagccctggctccagagttagggatgtggcttgaatcctcgctctgctacccagagcaaattatttacttctttgagcaaattatttacttctttgaacctcattttgttttctttaactaggatagctaatccaatagttttttcttcatcaagtcatatgtgaagtacttatcactaacctgttgtgtgtatgcatgttagtgctaagtacttcagcaattgatcatcattattatcaacctgagaaaactcactttattcttgtcaaaggaaaataaatctcaggacccaaaaatcactaagccaaagggaagtcaagctgggaactgcaatgggcacacctgcctcccattctattcctaaataagatagctacaaaaattaaaaagctacatgcttcccttgcagttttcccataaggaaattccttgtgaacaagagacagaactcagagtcatccctgtgctcacgtgagtcagagtccagcctgggcagcatagtgaggccctgtctcgacaaaaatttaaaaacttagctgagtgtgattgtgtggttggctcatgcctgtagttccaattacttgggaggctgaggtgggaggattgcttgagccaggttgctcaatgctgcagtgaggtatgacactgccactgcatgtcagcctggaagacagagtcagatcctatctctggaaaaaaaaaatgcttgtagaatgtaaacatgaggccctgtctctacaaaaagttgcttgggtgtggttgagcccaggagtttgaggttgcagtgagcaatgattgcaccattgcattccagcctggataacagagtaagatactgtttgaaacaggaaaaagaaacaaaaacaacatttgtatgtgggtatgttttatttccggggggctgctataacaaagtattatagattgtgtcttcatattttggaaggggaaaacaagctcattggggccgcttttttaagggcactaatcccatttatgagggctcttctgtcacgatccaatcaccatccaaaggcccaacctcttaataccaacaccttggggcttagaatttcaacaaacggattttggaggcaggggacataaatgttctgatagcagggctttttagaagtgtcatgaataattaaattctaatcatggtagccaagccatgtatcagctttcttataacttaattagaatgccaaatactgtggaagaaacaataacattgcaagcaaatgtgttattgttactttgaaggaagttatcttctagtatagtagaagtagtagatattgtagtggggtaaaacgtgttttctgacaatgactccttttaccagtagtgaactggtaaatgtttaacaaccagctctccagaaaaacaaaataaaacaaaacttatttgtaatgtttgtcaatttatgtggtgtaattactcctaccatgaccaatttcaaactatctatgtgacatctcatcactgaacacaggaagaaatgagaagtaacaaaattttatagtattttcaccatacaggtgcaataattgtaaatataaataacctcaagaacaaataatattaagttataattgaaagaatcaggaagtggtgaattttgaatatttattacttttgtatttaatatagtttacttaactatacttaatattattaactttgtataatttattttttaataatccctatgtttaacaaccagtctacaaaaattttaaaaatttaacaactggctcttataagtcattacaggcaagcttcagcacaccattatgcttaactgcccctcagatacacagcactcatagctatatatgtatgattttataggatatcctggccacagctgatgagagtaaatagggatgggaataggttcaatgtcacttctcccagaatttggaaagggaatcagactggaaatcatcctgtttgtgtggctgaaactataactcatgaaaatttgaagttacaggcagtcactttttgaccattatgtggacttagtagtaaataagatttatcttccagtatagaagcataaaaatatgcaaagggaaaccagaaatggggaaacacatctcatttgtcttaaagcattctagatttcagcggcagttcttgagacctggttgcattctacccttcgatttggacagatacatttaccctcacagtagttttccttttcctctaatataactcgaattgctttttgttatttgcaaacaaaaagatggacatgaaggaaaaaggaaatagcaaaatacgcaaaataataagcgtagtataatactgggtgaaaaatgttcaattgctctatagctcatagatcaaaatagagaactttgccctaactctattcgtagataatgaacattaggataaatatttcaactctcctttttgagaaaaccacaatctaaatacagctacctttctctgtagattctactgtaatgtgtgcttggatttaactgcctctcattgtaaacaagattgttttgaggcagctgaaaggtaaagagctttcctttggcaagctcaacaactcttgtgacttaatcatcatctatacaagaatgattacttcagtcagacttctcacctgatgtcagttgtttccttgacatcttttcttagatgtctcatgattagctcaattttaaaaagctcaacagtacccccttgatccaccactacccacactgtccactaacctactcatgctagggatctgggaattagccttctcctcacctcacatctccagcacttgcagtacagtgaggaagtgagggtgaaggggaaagggagctaaggtacagacaatggctaatttacatctcttggtggcaagtgttacaacaggaatagtatacaacactatagagacatacaatgggaataaatccatgagttagtcatatgctcctttctagaccgttctctgggtactcactgcctgaaaaacatgattttttcttacaggtttcagctaattctgcatctcaccaagaaatttttccttgacaacctctccctaacagaattagttgtctctgttgtgttcctgtaaccgagtatccccatttttcttaagaaaaagggaatgaataactattattattttctcttctctttttccttttccccttgatatggtttggctctgtgtccccacccaaatctcatctgaaattgtaatccttccccatgtgtcaaggaagggacctggccatggggcgataggatcatgggggcagtttccctcatggtgttctcaaaagatctgagttctcaaaagtgagaagtgagttctcaaaagatctgacagtttaaaggtgtgtggcagttcccccttcattctctcctgtcaccttgtgagaaggtgcttgcctctccttcaccctttaccatgattataagtttcctgaggcctcctcagccatgtggaactgtgaagcaattaaaccttttttaaataaatgagccagtctcgagtagttcttcatagcagtttaacaatggactaatacagagaattggtactggagtttgaggcactgctataaagatacttgaaaatgcagaagtgactttggaactggataatgggcagaggttggaacagtctggcgtgctcagaagaagacagaaagacatgggaacaagtttggaacttcttagagtctagttgagtgattttgaccaaaatgctgatattgatatggacaatgaagttcaggctgagatggtctcagatggagataaggaacttattgggaactggagtaaaggtcactcttgatatgctttactccagagactggcagcattttgcccctgccctggagatctgtggaactttgaacttgagagagatgatttaggttatctggaagaataaatttcctttttttttgagacagagtctcgctctgtcacccaggctggagtgcagtggcatgatctcggctcactgcaagctccgcctcccaggttcacaccattctcctgcctcagcctcccaagtagctgagactacaggcacccaccaccacacccagctacttttctgtatttgtttagtagagacggggtttcaccatgttggccaggatggtctcaatctcctgacctcgtgatctgcctgcctcagcctctgaaagtgctgggattactggcatgagccaccatgctcagcctataaatttctaagaagcaaagcattcaaagtgggatctggctttttctaaaagcctgcagtcatatgcattcacaaagagatgatctgaaattggaacttaggtttaaaagagaagtagagtgtaaaggtttggaaaagttgcagcctgaccatgtggtggaaaaggaaaacctgtttttgggggagaaattcaagtcagctgcagaaatctgcaaaagtaaagagaagccaaatgttaatagccaagacaatggggaaaacctctccagggtgtttcaaagttcttcacagcagtccctcccatcacagactcagaggccaaggaggaaaaaatggtttcgtgggccaggcccagggcccccctgctttgtacagctttgggacacggttccctgtgtcccagctgctccagtgccagccatggccaatggaggacaaggtacagcttagttcattgcttcagagggtgcaatccccaagccttgatggcttccacatggtgttaagcctgcaggtgtgcagaagacaagagttgagctttgggaacctccaactagatttcagaggatgtatggaaacgcctggatgtccagggagaagtcagctgcaggggcagagccctcatgcagagctcatactagggcaatgcagaggagaactgtggggtggagcccccacacagaacctccactggggcaccacctcatgcagctgtgagaagaggactactgtcctccagattcccaaatggaagattcactgacagcttgcactgtgtgcctagaaaaactgcaggcactcaatgtcaggacttaatgccacccaatgaaagcagctgcagtggctgtaccctgcccagagccacaagggcagagctgcctaaggtcttgggagcccaccccttgcatcagcatgacctggacgtgaggcatggagtcaaaagagattattttggagctctaacacttaatgactgccctattgagtttctgatttgcacgggggcctgtagcccctttgttttggccaatttttcccgtttgaaatgggaccatttacccaatacctgtaaccccatcatacactggaagttattaacttgcttttgattttacaggctcataagcagaacggacttgccttgtctcagttgagattttggacctggacttttgggttaatgctagaatgagttaagactttggggtactgttggaaaggcatgattgtgttttgaaatgtgagaaggatatgagctttgggcggggctgggatggaatgatgtgatttggctttgcatcccaacccaactctcatcttgaattgtaatccctgcatgtcaagggagggacctggtgggaggtgattggatcataggggcagtttcccccattctgttctcatgatagtgactgagttctcaccagatctgatggtttaaaagtgtgtggcagttcccccttcatgctctctctcccgctaccttgtgaagaaggtgcttgcttctctttcaccttccaccatgattgtaagtttcctcagtcttccccagccatgcagaactgtgaatcagttaaacctttttttttaaaataagttacccagtctcaggtagttctttatagcagtgtgaaaatggactgatacacccctgttctccactttctacttagtcttttagtaatgacaatatagccttttaccatccccttcaccagacgctccctacagggtaagttcatctatgcactctaagacggaactctctttgagagttaacagtcgatttatagaccaaagcatgcctgctatggaactctcacccaccagagggttacctcaagagataacaattgaaaaacatgtccgctactgtctcccagctagggagtttttatcatagtcctgcccacaaaaatgccagaagtcaccagcttgacctcctggtatgtaagggaccaagctaacatgcagacccctcaccttgctcacttcctctcctgccttttaaaagtgcctgctttaggttctcactcataagtaggagttgaagaatgaaaacacatggacacagggaggggaacaacacacaccatggcctgttgggaagttggggatgaggggaaggaacttagaggatgggtccgtaggtgcagcaaaccaccatggcacacatatacctatgtagcaaacctgcacgttctgtacatgtatcccagaacttaaagtaaaataaaaaaataaaaaaataaaaagaaaaaagaaaatgaaaaaacaaaaaaaggaaaaagaaagtaagtgcctgcttttgctccagaaacaaagtagtacatttaaagtcaagactcctgtgcttcttcccctaagctagcttgggaaataaatcactttgtttataccagacctcgcttttgttaattgggctctgcaagcattgagtgactaacctgcatttattagttacattctcactgcatttgtacttgtctccattacaacaattataattatagatacattttaagttactatggagccccagcagaatgcctgtcacatcaaaattatcaaagaagtatttagtaaagagaagaaaaaaaagaataaacagaagatatcaacagctctggattctaccagtgaccagcattcaatcaactctatataaattattctctctgttcctatattttctcctttgtccagtaagaaattggactcatggccagatgcagtggctcatgcctgtaatcccagcactttgggaggctcagtggggtggatcacttgagcccaggtgttctgagaccagcctgggcaaaatggggaaaccccattgtgggggttcagtcaggctggtgggaaaaattttagttatcatagccacaaaccctcttggaaggcctgagagtttgcataacttcagtaatagatctagctgaaggcagcctagtccctttacctttagttaaataggttaaagtagatacaaaggaatgtgggggagtttatctaactagcttgtttactcatgtggtcctaagactaatcttagtgtgcttaattgctttctactcgggaggtccgcaatgtcaattaccctctagtggtgttgactcaagcctttgtcaattaatctttactgaatgaatgtgagtcttgctgtgtctaggctggaggttccaactatttacagcactcttcttggtgtctgtaagtggcctggatgctcagccagactggcaaagcagaatatctgtgtcagtgcacgttattcatctgtcattgggtcagggtctgcaggacagacccctgcaccccatctctacaaaaaacaccccctgcaaaattgtctgggcatggtgccacatgcctgtagtcccagctacttgggagactgaagcgggaggattccctgagtccaggaggtggaggctgatataagccaggatcatatcattgcacttcagcctaggcaatagaatgagaccctgtctaaaaagaattaaaaaaaaaaaaaaaggaaagaaaggaaaaaaagaaaaacgatatggagcttgaactttccttgactttgggcacgtcacatggcttcgatttcttcatctataaaatgtcaaccacagagttattgtgaagatcaaatgagctgtgcatgtgaaatgaaactacctttacaagcattaaatgctataaaaattttaagcatggcttttagtagttttagctctaattttctattattctaaatagtggaatgtggtagaagtatatcactgttttttctttttttctttttaaccagtggtggggataaggggaaggaagtggttgaaaaatcgaaagggaacttcttacttgggtaagtctggacttaattgtgccaaactttctaaagcagcttccaggacaaatttccaggaatatttaaaaaattgtttagactgactggaacacagatatgaagccacattttttgtgcacgtgtgactatgtgtgcctctggaagatttcaacacaaacacgctctcatctaaattaacgctttcctctgaattgactcatttgaccagcataaccagtttgcatgccagtgcaagcagagaaagttgtaataaaaagaagaaaagaatgaaaggcatttagaaattcggtggttaaatgtacacttagttaatcattgtatttgtttttcaagggcttcctaaccttttggagaaagaaaaatatggcagaaagctgactgaagtttgaaattaatatgtgcaaaatgtctgtagaggatctagtctatcctcctttccttcatcttaagacttaattttatccaaaaattaagtagcctgattagtcatccttgctttcttctcttcctggctccttgggttttttcccatatgtatttgttcagcatctattacaaagcaggcactgcccaaggcattgtttttaatgtacaagtagggagtttgaaattcatcctttcgatcagaagttctcaaactatacggtgtatatgattcacaaggaaaatttgtccaaaatgcagatttctagtcttaatcccagatatcagatttgaggctcttcgtggggcctggcaatctgccattttaacaagtgtctgggagagctgtggctcatgcctattatgccagcactttggaaggacgatgcaagaggattgattggaatttgtgaccagcctaggcaacactgcatgactctgtctccacaaaaatttaaaaaattagccaggtgtggtgttgcatgactgtagtcccagctatttgggaggctgaggtgggaggatggagtgagctgtgatcgtgccactgcactccagcctgcgagacagaggtgagaccttgcctcaagagacaacaacagggccaaacgcggtggctcacgcctgcaatcccagcactttgggaggctgaggcaggcggatcacctgaagttgggagtttgagaccagcctgaccaacatggagaaaccccatctttactaaaaaatacaaaattagccaggcatggtggtgcgtgcctgtagtcccaggtgagacaggagaatcgcttgaacccgggaggtggaggttgcagtgagcgaagatggcaccactgcactccagcctgggcaacaagagagaaactctgtctcaaaaaaaaaaaaaaaagacaacaacaatggccgggttcagtggctcacgcgtgtaatcccagcactttgggaagccaaggagaatggattatctgaggtcaggagttcgagaccagactggccaacatggtgaaaccctgtctctactaaaaatacaaaaattagtcaggcatggtggcagacacctataatcccagctattcagtagggtaaggcaggagaatggcctgaacccaggaggcatagtttgcagtgagccgagatcgcaccactgcactccagcctgggtaacagatggagattccatctcaaaaaaaaaaaaaaaaaagacaacaacaaacaagtgataagcaattcaagggactccattcacctgtttgaaattaataaaacacttagtgattagattaggttggtgggcagctgaactcttcaagattttatctatatctctttaagaactccagaatcggggctctctgttcgaatccagactctgccacttaggagctattcagttgattgtattaatcaagttaacctctttgtactctgtgtcctcctctgtgacagtacatgggaatcaaaatatctacctcagagagtcactgggcagatttagcagataaagcatgggtgttatctggcatatagcagtaagtacaaaaaagtagctacaataataataacataacatataaattaatataataacattgttaccattattggcagtagttttactgtggctctattttttagagagaagagagaagacacaaagttttgcccacaataagtggtcaggtcttggaatatgactagatgattgcttcaaaagagagaagtgttctgactgcttgtatatgtcttctgaggcggaaattgctgttagtaacaaccattttagtttacattttctaaatattattaaatccctgagtagtaggtaatattattgctattctgacattttcttctcatggcttaatttaaaagaatcaaaattatacccagctcagagaggtaaataacaaatgttctcaagaagcatctaaggccaggtgcagtggctcacgcctgtaatcccagcactttgggaggccgaggcaggtggatcacgaggtccggagttcaagaccagcctgaacaatacagtgaaaccgcgtctctactaaaaatacaaaaattatctgggcgtggtggtgggagcctataatcccagctactagggaggctgaggcagggaactccttgaaccctggacgtgcaggttgcagtgagctgagatcgtgccactgcactccagcctggacgacagagtgagactccgtctcaaaaaaaaaaaaaaaaagcatctaaaacaggggtccccaacccccatgacacagattctggtccatggtctttaggaactgggttgcatagtaggaggtgaccagcaggcaagcaagtgagcattaccacctgagcaccacctcctgttggattagtggtggcattagattctcataggatcgtgaaccccattgcaaatcgtgcatgtgaaggagctacattgtaagctcctgatgagagtctaactaatgcctgatgatctgaggtggaatagtttcatctggaaaccattcatctctcttgtccatggaaaaattgttttccattaaactggtccctggtgccaaaaaggctggggactgctgatctaaaagatgtcctcatcataatcacagataatgaatacagaatactcagtatcggaggaaagataaaaagttcagtttgggtcaatttcttcactatttacatacacttagggccttagacccttccatgctaaaatttaaatgcatgcattagctcatttaatctataatagccctataagtaaattgctattataatccttatttatttatttatacatttttttgagatggagtctcgctctgttgcccaggctggagtgcagtggcataatcttggctcactgcaaccttcacttcccaggttcaagcgactctcctgcctcagcactccctgggactacaggtgtgcaccaccacaccacactaatttttaaaatattttttagtagagatggggtttcaccatgttggccaggttggccttgaactcctgaactcaggtgatcagcccaccttgacctcccagagtgctgggattacaggcgtgagccactgcgcctggcctataatctcattttaaaagatgccattataaaacatctttaaaaatgaaatttattctctgaagtgtcaacataataagaaagaaaaaaaagacacttaggttaactaaagtaataaaggaactcaaacttgaaccaagagctatgtgatcttacatctcactttagtctgcatatcaaaccgcctcctagacactttgaggctcacgggtctgaagtgggtgtagtggcatcctgggaagatttaataggacaacaaaggtaagtcacacaatgagctctaaattctagtctgtccaaagcatgctcctttctaaaattatattctaaaatgttaagaaaaaatacaaaaaagggcattttcagaaaatgttttatagtccttcctctgaatgactaactttaccttttttctacattgcatattctttatcccaaacatatgcagaacatgttgatgtgttctctgattacaaagtgttttcaaatgataatgtaatgactcagtagacttgtgaaatgcaggcagaaaaaaatcatttaaaaccaaaattgactgtgctgcttctacctgctaagggaagtggtctaattcgcatcagaggggtaagaggcagagttcccttccccttttgtaaaagaaaaatggggacagcaagcaaaaaatcactcaattgttaggaaaaaatatctaagccaccctctcaccttccttctctttcccaagaattggttgcactactgaaaccagaggagtgcaggaattccactattttgtaaaataagtttgagccaaatttgcctgaatttctaagacaggctactttggttgatacacggattaagcctaaaaataaaaccttttgagataaattgggtagtacacccacagaatcgcgcccgagtcaaggagggaaatccttttggtattgtgtttaaaaatcatttttaattttccctacaacgaagcgaaactcctcacatgtgtttaattgttcgctctgaaagactacacaggccgttacgaaaatagtttttggcatgagtagtgatctagttataaatcagtgaaaaataaattgtgtccataaaaaagttacagaatttacccctgtgccattaaatattagttaacaaccttgatttttaaattgatgtgccatattctaccatatcgatactgtatttgatatggttcagttgcagactgctcttccagaataaataggcagaaaggaatttatcactggctgcaaaccattagatggcttacaaactgtttggaattgtaggggcaggcgctgtgtgagcgtttaggaacaacttccattctccagaaatggcatgggtagtcctgcgatccaaaggcagcagtgtcaggtggaagcgctagaagcccgaggctgccattggcagaacaaagcagtctcggcctggcttggcagcatccaaaaggaccgcagccgccctgccgctgcacacggtgcatctgattggcggaacccaaacccttccgcagccctccctgcgaagatatctgggaaacgtagtttttaccttctaacctctaaggcacggaaagcttattcgatgttgattgtaatggaaatagaactatgtattaggatttgtttaaccatcccttgagttttaaattttttggttgttacgtaattttctctgtaataaataaataaaattccctaaacaatatgaatacttttcaaatttttgataatgattgcaaaattgctctcttgaaaagttatgccagtttatactccttccagcaatctttgttccatattgtcagtcatgattaatacatttgtcaatgcttttgaaaaggaaagtgacatattatttaaaaactatgaatttctttggctagtttgaagattttaattctcaccacaagtgaattacgattagatttttttttttttttttttgagatggagtctcactctatcacccaggctggagtgcagtggccaatctctgctcaccagcaacctccgcctcccgggttcaagagattctcgtgcctcagcctccagagtagctgggatttgaggcatacgccaccacactaggctaatttttgtatttttagtagagatggggtttttgtcctattggccaggctggtctcgaactcccgacctcaggtgattctctggcctcggcctcccaaattgctgggattataggggttagccctcgcgcacggccgcaattaagtctttagacgatctgtttccccagtatttcccagcaatgtatttatgaatcatctcgcatctcgcatggtgagaaacttaacatgaacgttcaaccatgtaaaattattaccagtgaaataaataacttaatgtctagtgacctcttactgtagctctgtattggtagatagacacttcttttttgatctttcaagtatatagtaaaaaaaatgttccttttacagttttcaatttttttttttttttttttttttgagatggagtctcgatctgtctcccaggctggagcgcagtggcctgatctcggctcactgcaacatccgcctccccggttgaagcgattctcctgcctcggcttcccaaggagctgggattacaggcatgcatcaccacgcctggctaatttttgtattttctttaaattagagacagggtttcaccatgttggccaggctattctcgaactcctgacctcaagtgatctgcccgcctcagactcccagagtgctgggattacaggtgtgagccaccgcgcctggctaatttttcatgtttttagtagagacggggtttctccatgttggccaagctggtctcaaactactgacctcaagtgatccacccgccttggcctcccaaagtgctgggattacaggcgtaagccatcgcgccctgccttgttttcaaaattaaacttagttgaagcctgtaagacttaaaatgaaagcaagattatgtgacttgattatgatgcagccaaatgaatttagatgcaaatgctagacttgaaatgtaagtgtacgaatatacagcagtataattttatgaggtctgggggttacttgtgcatgagcccaggatttagatatctggctactcacagtaagatccatggaaggaaataaattctataaggaagcactgtataactcaaagaaactagagaggcccaaatgtccaaagctgccatttcgcttgctggaatttgctggtggaataactacccttccccgaattaatgaggctaaatgaattcctggggaaccctcaggctgtcagtgtaacacctcccacatcttttttctccagcaggtggcatgtacagcaccatcctgaaatggtgataactttattattattattgtcactattcatggggctaaccatcttcccttttcttcccaaataagtacatggagttttagcataggtattaaagaaggctcgtcagcatgatggcttaagtctgtaatcccagctactggggaggctgaggtgggaaccgaggagttcaaggctacagtgagctatgatcatgccactgcactatagcctgagtgacagaaggagaccccgtctgtaaaaacaatttaaagagagaaagagaaagatagagagagagaggattcttgtttcaatgacctagaggaaaaaagatgttataagttcgcttttgaaactggaacattaatttttcaccatattaagacaagaccctgtatatacacgttaaacttaaacagctatcttttaggctgttgaatgcaagaaggtaagtttaagtaccatctagtggtaggcatcaccctccacctagtggcatccctctccatctagtggcaagataggcgaattgaaagcaagtgccaaagaagaaatagtctgatactgaaatgttgagcaaaagtttaaaaagacaacagtattgaccacgcctcctccaagtcccagcgagcccgtgtacaacctgtcccgactccagccgcctcttcagctcgccatggatcccaactgctcctgtgccgccagtgactcctgcacctgcgccggctcctgcaagtgcaaagagtgcaaatgcacctcctgcaagaaaagctgctgctcctgctgtcctgtgggctgtgccaagtgtgcccagggctgcatctgcaaaggggcgtcggacaagtgcagctgctgtgcctgatgctgggacagccctgcccccagatgtaaataacgcgacctctacaaacctggattttttatgtacaaccctgaccctgacgtttgctacattcctttttctatgaaataatgtgaatgataataaaacagctttgacttgaaaaaaaaaaaaaaaaagagaatagtattaaagtaccagataaactttaccactgttttattaaattttaatataaataaactatgtaaaataattcatgattgtagcaggttatctaatttggaaataaaaagaatactcttgctggatggtaaacagactattcctagcatgaggtcttttcttggaattattttatcttagtccttacctagaaggacttaggaagtgacaaacagtgctaaaaacctgagagaaaagttaagacatagtgacagaattttgcaggacaaaagagtgatattagtacagtctttcttatgttaaaccttttatgatcttgaaaatcttatctttaaatcttaagaagctgttggattatactttaatcattgcagggaaaagatttagaaattatgttgtcaaccagtttagatcaaattgacatcagaattgggtctttaggaggagatttttggtacaataactttgtaatctgaggatactaatcagggtataatagtacacttaattagtatgattagctgatagtctcaagttaggatgacagtcattgagcccatatcaggtagttaacagtgagcatctatctgttctaatatgttcagcattctgttaggattagttggtgtccatgctgtccttgttattaaatcatctgaatatcatccaagaccataagggactgtatgttcacaggaaaaaaataacaaaatcacaaaatgtgaagaatgtatgtattatgaaaagaaggtaggcaaacagatatctttaaaagaggaagctaaaaaaataaaaataaaagaggaagccaaatgaatggatcagatagaaaaaaatgttcaaaagtgtaataattgttttaaaaggactaaaaatatttttagagacccaaaggaggaaattagaaacatgaatcagaaaaatcagttatgaaggaccaactggagatattcagtatgaaaaacctaataactgaaataactcagtaagtatggtattagataaaccttatagatgttttttagatactgcttttcagagtgaacacacttgaaatacaaattagtgagctgaaagatcaggtcaatcaactcttctagaaggactcaggaaggacaaagcagtgctaaaaaactgagagaaaaggtaagatacagtgacagaattttgcaggacgaaagagtgatattagtacagtctttcttcagtatcttcaaggattggttcaaggacccactgccttcatagtaaaatccaggaatgctcaattcccttatataaaatggcctgtttgctcataatctacatacatcctcctgtatacattcaattatctctatattacatatgatacctaatacaataggaatgctatgtaaatagttgttatgctgctttggtttttatttgtatttttttaattgttaatttggttttttcttgaatattttcggtcccaggttgtttgaatctgtaaatgcagaacctcaagatacatagggctgagtgtatttgatagaaagaggacagagaaattgttgaaataagagaaatttgaagctaggatgctatatccaattaattcaatgtaaggctgaaataagttattgtaaggtacacaaggcctcagaaggctgacaaaaattctgtttgaaaacactttgggaggatgtgctcaagtaagacaaggaatcaatccagaagttaaccaagagatgtgaaaagtgtggaacaagtgaagctttgtaacgtgtttagataaaaaactgccagaggcatctttaatataaacagcttcaggaagagagacacactgtattgctttctttatcccagagattttggagcgtatacataggtgtcatgcatgtcgtatgtatatgtgcgtatttgttggaggaacaaagcccaacccccacccccgacaaaatcccatgagtttatttacacattgtacatgagaatttgcgctatttcctatcttcagacatgatatttaaaatatataacaattagtacaacatagggcactgaccaatcagaatagacaccagccaaactgctagagcagcttcctggatgctgtgcccttcatgtccggattatgagtacacctctggtgggctggggcagaggcatggggcaggggctcaaagtggcttctatttaccatgtatataggattgtttcaatattttaacaacttgtatggtcatgtatactgactgaatagcaactctgctatgagacataagacatgtttgatgacttcatgcaattttctgaaacatgctctttttttttttaaataaaccttgggcagatgttatgttaagacagtctctgtagtaaaataatttgccatattggagaggcttatcatctttacaatgaaagtcagaaaatataagtaaaacatattaagttgtactaaagcagagagaataatcaaatataatcttactcaagatattttcatgacaactcagcttgcaagatgttttcctaggcttactgggtcataaatattcggtatcattttttttcctatattttaaagaaaaggaatttggaacacgtaaactataaatctaagttttaaaaaatctaaacaacagtttcctctcattgcagacctcattcaaattgcaggctggagccatgcccaatatgcctcttcagagccacaactacccacaggtaggtgggcacttggtgagtgaggataaaaagtttgttgttataagtcattgagttgtgcagttgtttgttacacagcaaatgacattccttttttacttattcatcattcattcaacgtattctaaacatataactatgaactataaaaactcaaaactggcttttcttttaaaagactgactagacaaatttatgttaaaactaatcaggaaaggaatggagatgcaaataaacaacagcacctatgaagtttgcattctactattgaaacagaaaatacacaaataaactgggaatcccaaatggttcataagcaaacgaagagtgacttacccttactctgtaatcagagaactgcaaattaaaacaattggaaagtctgacaatatcatgcagtggtgaggatgttgggaaataagaaacctcccattcaacttaagggaaagtaagctgttgcaaccattccagggagcaacatgaaagtacttggtaaattaactatctttatactttctcaatgatgtagcaattacacttctaggtttcttgcacatgtccctaggaatatttttcacagcaatgtttgtggtagtaagaatggagaaagtctagatgtccattgacagaggaatgggaaataaaataagggatagacacataataaagttatattcagcactcagaaataatgttctagattaatatttatctggatggctcttaaaatatcatgacaaattggggaataaacaatatgagatttataaaagaataactttcaaggatattacatgcatatgcccagaaacaccaaattcatctttaaagatacacatatatctaaatgaatatagcaatgatatactggtagggtataaattaaatatgtaagggtggggtgaggtgagaatggtggatgcatgggaaaaaggtagtaaaaagtagaaaggtaaaatttaaaaaggggtattgcacagacgctgaaaatgtgcaatgaaatgaagggtgtgattaattcaattttgtgacttgatagtctaaaaataactatatgtagtagaatctgaaatatgaggaatagggaactttaagggagtatatggaagtcaacgccgtctaagcatgtgcacactgaattctcacactttcgatgatgtcctgctattatatcttttctaagcttagaggaagataaataccacagtagttatattttaattctagttttatttaggtaaatgataataatgagataagccacaaagttcgaattgacatatctattagtattagtatacataaatgtagaaaatatatttcaaaagaaaaaagaacgtactatgatcatcaaaaacctcacctttccacatgatacatattgttgatattttgatatttttccaccatggaatttattttgcaattaccttgttaatcagtataatgtataatgtgaggattaaattgcatctatggatcttgatgtgttatctttagaacttatttagattgaagctttcattttatctttttcaaactactatattaatgatcttgaatgaagattattataggagttcagtgcctcgcaaaattttcttgtacttaccctgtgcttcatactcttattgtcttgcctcctttgaataatcacaaaagaaaaagaaggcaaaggagtatatagcacaacctattagaggaaatggctgaaatagtattctcttaatgtttaatgtgactattaagagggtattatgctggcatgtaaaacagttaattgtattcagtgtgttttaacatcactgattaattgatggcgtagtgaatgttcatcttggagaaaataccacctttgtatctcaggggatctaaagaatgtcttttgctgctgaataaagtgcttcaaaaagttcaaagggagaaatgtgtatttttttttatggtaaggaagaatagattttaccacttgggaaagtaacagcttatgaaatcacgcagtgatgactgtaattcagctgtcgtctgtttctttcaccttctaaccagtgaaaaaagttaggttacttatttctttgactaagtaaattgaaaaggaataaattcagaaagattatctaaggaaactggttattagagcaaaatggtttgtattcactctgtaaatgaatgctcctgctgcttttctcttcattttaatcataatatttcttttttccagttgcttcatgtgaattttattttattgtttgtttttgtttttgagatggagtctcgctctgttgcccaggatggagtgcagtggtgccatgtcggctcactgcaatctcctcctcccgggttcaagcaattctcctgcttcagcctccccagtagctggaactacaggcatgaggcaccacgactggctaatttttttgtatttttagtagagatggggtttcaccatgttggtcaggctggtctcaaactcctgacctcaaatgatctgcccgccctggcctcccaaagtgctgggattacagcttgagccactgtgcctggccgtgaatttttaaatatatcacatttcaaaataattttgcagttccaaaataattattttgtaattcaaagacagttgaataagcaaatcccttgggatttgattgtgtcagaattataaggtcctgcttatttttatttttatttttggaatttgtctgatggttgcagattattgtcaccggttcctcacgtttgttcccaaaagaagtaggatttgtgagacttggttccacctttgattttgatccatccctctgaatcaggctaagtcacagactccctaggtcattgccacaattttataagtaagacaactaaaaataatctatagtactcactttcaaaagatcaatcactcaattcactgagtgttaataactgatttagctcagggagaaggacatttctcttattattctctataagaaggtaaaatatctaggttcttacatttttgaatagcaaagtaatgttgaaattagatggacaccttgacatgaatctgaataaaaataacatatctcaggaatcttttagtattatattattgatataaaaattattaaaataggctgagcgctgtggcttacgcctgtaatcccagcactttgggaggctgaggtgggcggatcacgaggtctggagatcgagaccatcctggctaataaggtgaaaccctgtctctactaaaaatacaaaaaaaaaaaattagccgggcgtgacggcgggcgcctgtagtcccagctactcgggaggctgaggaaggagaatggcgtgaacctggaaggcggagcttgcagtgagccgagatcgcgccactgcactccagcctgggcaacagagcaagactccatccccccaaaaaaaaaaaaattattaaaatagcaatattattaatgtctacacttggtcttagccaaaaggccaagaagatatagtttcttaaatttctgagatctttctaatttataaaatgctttaatatacagctttatttttattaatttaatttaatttaatttatttattttttagatacagagtcttgctatgttgcccagcctagacttgaactcctgggcccaagtgatccttttgcctcagactcctaaatagctggtactaggcgtgcgcatcactgtaccttacctccatacgcagctttttagaggcagaaactatttcactgacttctatcccttaaacccagaaattgccagacataggttaataagtgcctaaagtaaacttcagtcttttgttgctgtttcccacctcctatatttgaggaattctctgcaatatgtatctttaacagaagctccaaaggccatgtgctctatatcccatctttctcttcaactacagcacagtaacgtaacttaggctcacctgatcagctgtacccagttgaactttcactgggagctggtgatgcaaaagagtagcaatggtggagaatctattctgatagtggcagcagtatagatagcaacaacctgttccagggcagtagtggaaatgaaactagtggtggcatacggtggctggtgcctgaggtgatggctgtacatgtggtggcatccagtgttcagccatggtgggagcagtccccttatgaccctggatctatggttttacttgtggatctggctggtgcatagtgctcattgttgatcttccctttttcaaaacttgtttctttattcttcttgacaattctcttagatatataaaatccttttaataaattctgtttaaattagaattggcttctgtcacttgcattaatatacttgacaaataaaatatgaaactgacttgcatagctctataaccctatcaagacaggttttacgaatactgtttatatatcagtaagcaaagactaagagacagtaatttacttggctaagattaacgtttagtaagaacgaagagccaggaatcatacatagtcactccgattctatgcctgggtctctttcttccctatcacagtgtggcagagatgggttaattttctaagtacacagaaagcttacatttcacaacttctcttttaattctcagcatcatcacttggtgtagagtcccccagagagcaacctgatccatatcacaaacctgagacaaattttggttgccttaagcccttacaatttggagtttattcttatagcagctaatgatctttactccaattaatgcagaaattagtaacaaaattgaggtgctgtcataacaaaaacttaaaatacgtgacattgacagctgttagctggatagtgaggagagagataccagagatctatgttatatggtggtaaaatttttggtaaatttattaccttcttacaagacagaaaatgtacctactgggcttgtcgttttagaggaagagtttgcaaaatcaaatgttggcagagtttgttgggaccgttggcttatttggaaaagtgtagtaataaaagagatgttcccagaagaagattgaccaattgatgaacagaaatgaaagtagagagagaacagaaattcagagcttttcaagttgaatagtcctaactttgaaaccctaaatggtaagaaatggacttacaaaaggctttgaatgaaagaagtccagtacaacttgacactaatagttggataaagggactcacagcaaagatcagattagggtatgccttacacattgtttgctccaaatagactcaaaatacctgccattaagtaaaaagaggaaccacagtggcaaagaagcaacacagatcagactagacaatcatttctaggaataaactattggtatagttactggcacgtggatttgattggaaacaaacagatagaagaatataaaattttgaataaatgattttgccaatggagtcatgaaattgcaataaaaaaacacgtaagatatcagaatttaacacaacctgcatgtcctagaccttcaagcaggtggcaggcagtaggcagtagacttgcacattcatatagctgccaaaaaggtcatgtgccccagttcccactgcagatgcggtcaaggagaataacagacagggggataccttccagagggtgaggacattgcataaaagaactctctccagaaggcataaacagtgcctaatgaagaatttctcctgtccccaaggcaatgtctgcccaatgggattttaaaattgccccaaaccagttgctgtgtttctttttccccttctaaatggaagcgtctattgtggtaattgtaacccttctccaccgttgtaattagatatgtatttattgtctttttagttcataggtctccggagcctggggcatcgcatctagatggaaaggactgaatatcaactgaagagcctaaattttgggctgatgcagtcagtgattaagagttttgggtcagtgatggggcgaatatgtttcatgtgtgggaagataaataaaaggggtgatgcatgaccagaaaggaggactgtggcagaaacagcctagatgctcaccaatcttatttctactgtttgggcagatggaaactgctatagttcaaagcctctcttggagttagattgcaatcatatgaatgagaaatagaatgtgagcgaaactcactggtgtcacttccaaacttggctctttaaatgttcttcacaatcattcatgtactcactctactgtcttatgactattgtacatattcatgcacataatgatgtttccatacatataatgtgtaataatcagatcagggagagtcgcatatctatcagctcaaatgtttatcatttctctgtgttgggaatgttcaatatcttccttctagctatttgaaactatatattattgttaactcctgtcatcctacagtagtatagattattataagttattcctcctatctagctgtaattttatatcctttaacaaatctctccctgtctctcagtaaagtatcctgagatagtggaacttctctggttaacacttggaaaagaattgctgaaaagagccgtctcaccaactttgggctgtgattttgttttgtgaagtcattgtgattttgggatggttgtttatagcagctagcaagtcttagcatggcaaatacagtaactgtcatactaaaaaatatgatgcagaataaattatgttaggtagattaaataaatctatattattaataaataatatttgtaagtctgaattttatctgttggaatgtcagaaaagaatggggattatataaaaaagaattgttagaaaccagagtgtatcctatataggatcattagtgaagaaatagatggaaaagtggaaatgaataactatttcttccacacagaataaaacccagaaacaaagaaaagttaagtagtattagatagtgattcccaagcctgggaatgggagtcagtgatactcacctaggagagaatattaggaaggagtgagtgacatgaaaaaaaagtcacggagggaaagggtaaagttttagtaagtcctatggatgacaattatgtattacctgcagcttgtcctactagaggaatagtctctgtgccaagaggaaaaaaaaaggctcagaatttctgatctaagacataggtaattaagaactcaaaaggaaaaatgtagtcagtgtataagatgatggaaatcttgttttaagagaactgaattattggagaatgtgtaaagaagaaagaggtgttaaacttttgaaggggagtcagatttgctcacatttttaacctttaacagtttcccacttttttttttgaaacggagtttcactcgtgttgcctaggctggagtgcaatggtgcgatctcggctcacagcaacctccacctcccaggttcaagtgattctcctgcctcagcttcccaagtagctgggattacaggcccgtgccaccatacccggctaattttttgtatctttagtagaaacagggtttcaccatgttggccaggctggtctggaactcctggcctcgtgatctgcctgcctcagcctcccaaagtgctgagattacaggcgtgagccacagtgcctggccatactttattctttatgatacaatgtctcactctgttgtccaggctggaatgcagtggcagaatcacaggtcactgcagccttgacctcctgggctaaagtaatcctctaccccagccttccaagtagctgggaccacaggtgtgcaccaccacgcctggctaatttttaaattttttgtaggtatcactatgttgcccaggctggtcttgaactcctgggctcaagcaatcctcccatcttggcttcccaaagtattgggattacaggagtgagccactgtgcctggcctggatgggtaacctttgaaaagttatgtaaaatctgtgtgcctcaatgaggatagtaatagaaacttccctggaattacttgaagtttaaatgagttaatctatgtaaacaacctagaacgggccgggcacagtggctcacgactgtaatcccagcactttaggaggccaaggtgggtggatctcctgaggtcaggagttccagaccagtcaggccaacatggcgaaaccccatctctactaaaaatacaaaaactagctgggggtggtggcacatgcctgtaatccccgctcctcgagaggctaaggcaggagaatagtttgaacacaggaggcagaggttgcagtgagtcgagactgtgccactgcactctagcctgggcagcagagagagactccatctcaaaaaaaaaaaaaaaaaaaaaaaaaaaaaaaaaaaaaaaaaaaaagaacctagaacaatggctggcatagaggcatagaataagcattatatgtattagctatgattacaaaagaggaatctataaggtattctgcagacaaagagaaggaagtggctaatttagtctgcagagtagagaagaaactcagagagctgcaatttgcaaagcaaggaggagagatgaatatttgttttgttttgttttttgagaccaagtttcagtcttgttgcccaggctggaatggaatggcatgatcccggctcactgcaacctctgcctccaggattcaagcgattctcctgcctcagcctcccaagtagctggaattacaggcactcactaccatgcctggctaatttttgtgtttttagtagagacggggttttaccatgttggccaggctggtctcgaactcctgacctcaggtgatccacccgcctcggcctccctaagtgctgggattacaggcatgaaccaccgtgcccagccgagagatgaatattaaaacatatttgagggactttagaaattgtcagtctttaaagtctgtaagaaggatggtctggatgactcctttagcatgaactcattatttagtagatgactccatcccagttagtatttatgcctgtggaaatctcatatgaagagctagatctgatcagcagctctattatatctagcttaatgctcacaatttgttccacaaagccattctctctctctctctgtctttccctccttccattttgttagatcacatattataatagttatatgctttaaacccttatttggaacaataaagatgactgacttacatttcagacattgtcgctccatgtcgctagttttaaaacctgcccaacttagtaataaaaagtaatggctcctcagataagagtttcatgatagtttcttagaaacgagtcaatgacactactgtaatagcaggggaaaagatttctaagtcacatcatattttcaaactgacaattttagctacaaaagtacaacttccaagaggtctttcccaggtaaacatggaagggatttaccagtccacagaaaagtgactgcctctcccttggataaatgagattctttgcttcctgaaaatgagaaactgctatttcaatttcaatgccaaagatcaaattttctgactactgtgaatgaggctgctcagcatttacaacactaaaaacaaagaaaagaaagccgaagaggaacaatttttttttagcatttgccccaggcctttgcaatcaaagcataacccagcttatttttggggtgactacaccctccattctccaggtagttgaatcttccttgcatgtgtgaaagcatcactgacaaagtttcgttgtcatggagtttttagataagtatctctgagtttaaaatcccaaattatatgcatccacccacccttatactataattaatatctgtcttggggctttttagaaataactacacacatcaacagtttcacaactgcttctgtgagtggtgagattagtaggcagatttctaggggaattatgcaggtgaccagtcattaatatgcacattgttaaaatgtttgaacgttgtcatgatgatgatacagcgccgatgagtggaggaacaccaagttcttcgtcctcatgctggtttagataaaacgacactgacacacgtggagtggttttaaggagcggaaagtttaataggcaagaaagaaaagagaaggcagaaggaagaggctctcctgtacagagacagagggaggggggctccaaagccgagagagggaaccccatctggcagggataccagccaggtatatatacagaggctggaggaggcagtgtctgatttgtatagggctcaggggattggtttgacaaagcatgtcattcatatagcccaggaaaaagcctgccctcccaccctagccttttaatatgccaatgcagggcaccatgatgttctacccacgtggggatatgtgggggcggccatgttgccaggaagtgtggggcaaggtcaagatggcagtgggaatagccatgtttgggtggacccagtttctaatggatggcatttgcatatcaaaggttgccagcctggctctaagagctgctttaaaaacgaaaacttcccaaggaccccttttcctctctatctgcctaaaataatttcttaataactcctacaacaatgacaccaaggggccaaattctaagattccaccaacatgatgcagttggcttggcacttcataactcaattaaagggatttttgagggttgttgccttaggtgtacactgcatgctttgaagtttttcctcataaagaacataatgcagtaacttaggagagaccattaaagcatttttccctttaagaactgcagcaataattataatctggtagctactttcttatgttcttgtaagataactagtcatcaacaaatttttttctctattaatttcactgcgatcaaatatttctcaatgaaaataaaagataggaatttcctgtatatatataaactcagttattttgaaacaacacataacattagaattgagaaagaccatggaaatattgatttcagtgtgaatgaaaaagaaaaacttgggaccttaattcactatgccaaaaaagaaaaaaattaagctgaaagatgagtcatgcaagaaactgcctttccttttgttcctaagcagatagctacagataaaagttaaacatctccactgactgctactccatgttcaccttattttatgtaaagtgccgatttactgagcccaagatcaatacttaactgacaattcccctacttgttcattttcctctgcagcttgtggattaccatactctccccttttcccctccagctggcttttcctctttaaatattgaagcctgcaaattcatccttggagaaaggcacagaccacagactgcttctgttattccatgttcatttcttcctggcatgtccttaaccttggcaaaacaaacttctaaatctatttagatcacagaaaggattttttatttctatacttctttaatgtgtttttaaatgtctgcctaatagttcatgcagttgatattccataatctcatcatgattgagtttatttctcagctgtatagaagaggacacaaaggaacagaaaaggcaagtatctcatccaggatttcctagctagtaaaatgaatgcaggaaaaagggaaaggccaagaacagtcacatctatctgtcttttcattttgtttcttcttttgcttttcatgcttagaaattctttctccgcctagagatgagatgaatattcaattatggtttcttccaattgtttctggtgctcatttttatatttatatttaacctaagataatctggaatatattttggtagaacaaataaattagatgtttgttctaagagaagtcttgatgaaatgattaaaaagtttatctataagaattaacagataatacaactgagaaatctttaaaaggaagagtactggaacaggtaacttgtactgacaaaaattgaaactgataatcatcgtaacaattagattagcatgcaccgttttaaggaaaacaagatcaattctatttagcataaaagcagcaattaaaatgatatgaaaatctgtttttctcagacagcatattagtttattaatttagtatttgataattttttcagatacagataatatctaagtgataatttaaaaaaatccaaacatcctaaataaaaatctaagccaaaatctcataacaagcctgtctcttaatgagctgtgacagtgaaataatcctttttacatggtgatagctgatattgtgatagctgtaaacttagctgtcatcacagatcttggctacagaggctgctgtggtaacgagtgaacctaatgggctttgtttacttgagtgaggagttttcttcatgccccaaccctgcctgcttgcaatgtgcatctgaagccaggaggatgtctctccaactgatcgtatatttctttcttgtttttcctttttttttttttttttttgagatggagttttgctcttgttgcccaggctggaatgcaatggcacgatcttggctcactgcagcctctgtctgctgggttcaagcgattctcctacctcagcctcctgagtagctgggattacaggtgcctgccaccacccctggccaattttctgtatttttagtagagacggggtttctccatgttggccagcctggtctcaaactcctggcctcaggtgatccacccttctcagcctcccaaagtgctgggattacaggcatgagccaccgtgcccagccagatcctactatctttctacttttgaattgcaatgtggtttatgtctttggattttaataagcacaaaactcctcctagaattagcaagatatcaaaaaaggcctccaagtggagagcatttggccttgacctcatgtaggaaagaaaggagttggccaggtgtggtggctcctacctgtaatcccagcattttgtgaggcagaggaggatggatcacttgagctcaggagttcgagaccagcctgggcaacacaacaaaaccctgtctccacaaaaagtacaaaaattagatgggcatggtggtgtacgcctgtaatcccagctagtagggtggctgaggcaggtgagttgcttgaacctagaaggcggaggctgcagtgagctgagattgtgccactgcactctggcctgggccacagaatgagacactgtctcaagaaaaaaacaaaacgaaacagggagagtttgaagaacaataattctataattaaagtgtttttagaatagccctcaaggatcctctttctatcttttatactaccaaacctataaacatatatgtggtttccaggatgaggaacacaatacttgagatggaaaactaaagaccggctatgagctccaaggttgaggaacatatttgctgaacccttttccttaaattacatttatagaaataggaaaaatggaatatctccattaggcataatttaaaagcactgaagaagtgtagggatgtgaaaacacttctaaaaaagcaagcttggcaaaataccaacttttctcgaggaaccaatccattctatttttctgtttgtttgtcccaggttcttaagcagcatctgatttctaaactcttacaagggtagtctggataaagcacgttttattttctctgttgaaaactaagtattgcttaaatggagaatcatgccttatttggtagtacgcaaaggtttaaggcattttttttccttagatgagggatatcaatacagaaaagtctgtcactctgttttaaaatttatataagctcaaagtttcaagtgctagttcatgggggaaagaatttgtttattttttgtttttgcattttctatgacatcttttagcataaagccttacagagatcatttttttaaatagtagaaacataaatgcttattgaactgagcactctagccaaggaaaaacttttcattaattttgagataagaggcaaaaatgaaagcatattataaaccttactgattatttcttccttactttggctattggccatcttttagttgaagcatatacatttattaaatgtattaataaatacattaaattaataaagtcccatattaaagaagtttatggaaagatctctccttatgtcttagtgttctcttccaggaagagggtatacagactttatagaaagtagatattccctcttatcttgtaatatatgtccttgtgcagcatgagaagaaaactttaagatcacagactagcctaagaaaaatgatttatctttcagcaaatatttctcatccataatttactttggcttacttctgtgtctacaagtgtctgttgtagcatataaatgaaactagtttcaaacaacttttcaggtgcaataacaaaatgtatgtaccagagcttctggatagctgaacacatgtcagttcctggagggcggtgtgcccagggatggcatggaagctctgtgccccttcccctatgtctcaccctatgcacctcttcatctgtatcttttgtaatatcttttatttactttttttttttagagacaaggtcttgctctgtcacccaggatggagtgaagtggtgcgatctgggctcactacaacctcctcctcccaagttcaagcaattctcctgcctcagcctcccaagtagctgggattaccggcatacaccaccatgcctggccaattattgtatttttaatagaaacggcatttttacagtgttggccaggctggtctcgaactcctgacatcaagctatccgcctgcctcggcctcccaaagtgttgggattacaggcatgagccaccgcacctagcctgcaatatcttttacaataaaccagtagatgtaagcatttccctgagttctgtgggctgttccagcaaattaactgaacccaaaaaaggggtcatgggaactgcaacttgaagcgcggtggtcagaagttccagaggcccagacttgcaactggtttgtgtgtagttggcagtcttggggatggagccctcagtttgtggaatctgactctatctctgggtagataggattggaatggaactaaagaacatccagctggtgtctgccgcttggtgtgttaggaaaaaactccatgcatttggtcatagaattcttcttctgtgttgatgactgttgtgttgtcagaggagagagaaaacacagttagggagagttcccctacacaattgatgtcagtgaaatgggatttgctagaacagccctcactcacagaaacatgtggtttaggaagagaaaggctaaaaggctgggaggatgaggaatctttgattcctgggtgaccatcgtggtcacccatgatatgaagttgcagttgtgttgagatcagttactacaggtgaaagttaccagcggaatttagagatggatagaactccccaggaattggttcactggatgcaaaagggaatgcaaactaataagaaaaaagcaaaatattcagttctttggttgttgttacttaaaattgctaaaatgaaagtaaaatagggtgctgcatcaggacttgaagttggaccaagttcagatggggacatgtctgagcttagttaggccactagcctcaaagtcacacacaaaggagaaaattatgcagggacagtagaaagtacctctgaaacctgtggaagacagtcaatgtgaaggcagggcaaaaccaagtaactatttaaactattagagtaggtagttaggtaggcatgagcaggacaggagcgaggccccatccagaaatgccaggcaaccatcaggtgatggttagttggttgttaaactgttgctctaaaataataattgttcacagccaatgcagggaaaaacagtctcccaataaatagacaatacctgaaactggtgatcagcagcttcctgataagatttcaggagttgggtgaacaggctcaagaatgcccactaaaaagcaaaatggcagagattaactggtatatgatctttctctaggaaaacttgactggtaaggaaaaaatgcctcaaatgagcatgtgtacaactttggcaaacacagtgtgcatgttgcccctccccaagtgctggcggaccagtgtgcatgcagatagcccaccccaagggaagaatcaggggagaagaaatgcaaaccttggaacgatgccaatgtattctttcctccttgcaggcaagaatcgtttgctgcagacctgttggattcacagctggtaacaaaaccggagagtatagtgtgaaggaattgtttcatttttgtagaatggtgttatcagcttcctgaggaactattgctaaaatggattataagaatgacaaatgtaggggcagtgtctttggtttcaaatcttgcagagtgaagagcatgtttgggttgatataggacccacagctgaccatttgaacaatcacagatgggtatatatgatccagatatgtaggttattccgcaaggaacagccagtctgatagattggataaaagccattataagatctatttgagaaggtggactgttgaactccacctataaatgccaagtggaacaccttacataaggcagctgatacaattcatatgcaagccatgtgtgactggctttatgaggacatgaatattcactcagtgaatatgtccattacccaggtcacggtaaatactctggttaaggggaccccatgtgacattactcctgcagactcaaatagttcaagaagccttatcaaatttgtggactgagtttcccctcatggatctcacagatgctaataaaaacattaggttaattaataagagaacagtgaaaggcaaaagggagagtcaaagactcatccccggaagatagaaattttaaaatggttattaaaaaataaggtgaatgaagaaaacattgatggggtgaaactaagaagaaaaagaaaggggagagtcatgggactcgtcccagcagaatggaaaactttagatgcttattaagaaatagaatcaataaaatagacattgatggggttaagcaaaggtcttaatacaacactattgtaggttggatggaccagagggggccccatcttgttccccaacattaaaaggccgcaaaccagtctgctgtatttctgccagcttggagaaatttaaaaagctggaaggcagagattacaatgaaaaatcagatctaaaattgcctggggcaacagtcaggcagactaatcgagataaagattaataaaagggccagggtccttgggctcaatccttggctggggacccaaagctttttacacaagagagggtaaaatgacctgggggtaaagaagagaagatcctgaaactagaacataaaaatgtaagagttgataggactatggaagttggtatatttgaaaacactttatgtgaagtgattgcatctcttttacctgatttttttttttgtgggaatgaacaaagtatctcattgggaaatatttctcctccctggtgctgtaaaacagaaggcatgtaataatctgccctcaagcaatattaattggacatgctaaatgggaaccagtgagattgcccaagtccacacagtgcagagtagaagctagaatgctgttatggataaattctccacttgataagcctctgtgatgctatttcctggatcttgtggcaaaagcctctgagcacctcccagcaacatctactgggactttggactatggaacttccatctgaggggcatttactgctttgctgtgaaatgttaggtgaagctaccgctattaacacctgaaatacccatgttggcccagcgatgtcagagaaacattctaacagggatggcagtgcccaggagagttccataataaaatggacatggtttatcgaggatcatgccacctaagaactgcaaggaggggatactcttgagcagggtgtttcttttctcctgagactgactctggaactgtgtgagaaactgctggattctacagtgcctgataaatggctctcaactcatgagaaagagctacttagtttgtggccggtaattccaaggtaaatggacaccattgtgtttggaaggcagctactttgataaaagaaggtaaaaacagatctgcttggtgggctgaattgcacactgtttttctaacagtgatggaagaattgatcaatggtaaaagcccctgagtttgggtgtttactgagctgtgggcagtgtgacccatggcctggccatacactcaggcaagagggccatggaaatttggcctattaaatggatgcacataggagcactgttctatggagatttgaggggtgcattaaagaagaacaagtgaatgcccatcagaagaactcccttccaggttcagaaagtgactggaattgacaagcagatatccccatgtactcccttgaagtggccacctgggcctttgaaatgagtggatatgggggtattgtaacagggcagagatgggctgaatgtagagatggtttttttgcaccttctcaggcacaaaatgccagaaagaactgttgtgtttctcaataagaaagccagagactgctgacggctttgggacagattctctggtgggaaggccctgaacatagctggcaagtgcgacaaatgctggtagccctggaggctacaaatgggtcttgacaggaatagacactggctatggagtggatgttgcttgcccagaagaagatgaaaattctctgagtgccataaaaaaccggaacagaagatattacatggatatagatggctaaccatcagtttttcagaccaaggaacacactgtacagcccataagaatagtccaacaatggacaaagagatatccacctagagtaatagtttgatagagcagtagagcaggcaattgaaacattgattgtgtaaaacagggggagataaaagcacaaagggctggctcacatgccttcctgtctgctcacactcaacatgagcaggactagagtgtttctgctagattttttttctttgtttttctggttgatctggggaacagggagttgggaggatgctggtatgactatgccattcttgccaagggacgagtacactggtataacaaatgtaagtttttctttcttccccaaatcacctaaaagaaatttatttttttctcccctggctgatgcagtggtcctaggaccaggactgcaattacaactgctggattagcaggggtgatttctaagcaaaaacctgtaactgtgttttgaaaccttatatcaaaattcccaaaggcatgatgggagtgggttgtgtcttcatgctatctagaaaaattggggctatcagtgaatgcagctatattgcctggtggtaaaaatagctcactagttctgcacctatgtaaccttacccggtctgaattggcgtggactgaggaggagctaattgctagacttgtattactacttgcaacgtagaccggcactgtggtggttctaatttctcttccaaaggtgaaaaggtttaggtattaatggagagaaggagaaatagtagctgagagtaaataaatgaataaatgagttattaattgagaaaaattcagtattacataacaactcaaaagagtctcagagcaagagatgacattgtctcttagcttaattatcccagatgccttaaagggtgaagctgcgtatttactgaggccactcctgctttcgagacctgacaagattgagaggaaacttgcaaccctgagtggcctcatcctggaagacattcaaacaatatgaaggatttgattaattgttaatgattgtgcataatatatatatttttgaagtaaaggcaccatggtggaaaaccagggagtggcctgtggtgttatgatatacactggttttagtccacagttcctggcttataactcctatatcccttgttacaatattttcttttttttatataatgttgggtatgttaggcctcaggagcaagcctctgaccttctcctgccttactttcactctaatgtttccccactttctaattgtgacgcttaagactctcacaggagagggttccatcctatatcctgagggaaggaatgctgatgtcatgaagctttcataaaaacccaagaggacagggttcagtgagcttccggatagctgaacatgtggcacttcctggagggtggcgcacccagggagggcatggaagctccgggccccttccttcataccttcccctatggttctcttcatctggatcctttgcaatatcctttataataaaccagtacatgtaagaaaaaaaaaaaaaatgtacttacagtttccttccttccttccttctccttccttccttccttccctccctccctccctccctccctccctccctccctcctttctttctttctttctttcttccttccttccttccttccttccttccttccttcttccttccttccttccttttctttcctctctctctttctgacaaactctcgcactgtcaccaggctggagtgcagtggcatgatcttggctcactgcaactcctacctcctgggttcaagctattctcctgcctcaacctcccaagtagctgtgactataggcacatgccaccaagcccagctaattttttttgtatttttagtagagacggggtttcaccatgttggccaggatggtctcatctcttgaccttgtgatccacctgcctcggcctcccaaagtgctgggattacaggcgtgagccaccatgcctggccaacctacagtattttttctaaggccatctctagctgcatacttaccacactaggtaaattttctgtaaaggcatatgccataaatcaggatttttttgttgtggttttttggtcaagattagtttctacatatcatccagtatttgttacgtctaatgagaggttgtatatatacatgtgaatgtttcaggaccatatggcaattattccatttaaaatattgctgtcctacttctcagaaaaaaggcaaggcataaattattgtttttactattttaaaaaatgtagcccttcatcagagcttagatctataggtataaattactaatgctcatccctttccagtggcaaaaaggagatatcaaattattttgagatttgagtaagaataaaattaataaatagcaagaggacaggtgtgtgaaagttttcatatgagtaacgctcgggttacttatttctttccttttaacaagaattatttagcccttgcctggctcttgctgcagtcaatttgagaggaaaggacatcttgccattgattttaattattcccagtcatcccattccttttttagtagattgaaactctcttgggctggttttctagctccacctacgtattggttggcactgtcttcatttaattttgcctgttattattccttcataatgcctttccctgaagtgacagaacatccttcacctgccaaggtcagcagtttgctacaggagatgacacttccaggatcatatgccaagtctatgtaagggcacaagcgaacggtggtggtaactaatagtcttaaagttatcttgtttattcttatttcagctttcctgctatattttttgcatactctctaaagtaatacatggtaattggaaaaatgtgagaagataaaaaagaaaatcagagagaatgagattgtgtattaattagttatcaccaaacaaaactccagactgtataaataccaaacaaactccagactgtataaaaagtaaaaacaggaaataatcatttcaaaatttcattggattaatgttttctattcctgcattcttccccctccttcttacctcttcctcctcatctttcttcttttccccatgtcaagtaatttccaagatggcccaggaataaagatatgcagttacaaaacattctagccctaactagtaagaacaaatattctctttctgtgaatagaaaggatagatggatctgtatatacacagacttgcatgtgagtttttagaatatgtacatcagttagattgtgttaaggcacaaagccatagagttatgccccacattaggaaatacttccaggaatgtgtattgcatgaataaataaatgaaccaatagcttactatgtgtcagattctttgctgtcctttaaatagatgatcttattgaatcttttccccatattaggaaatacttctaggaataagtattgcatgaataaatgatgaaccaatagcttactatgtgtcagattctttgctgtcctttaaatagatgatcttgttgaaaattcactgtgaaaagaatggggatctagcatgataaaaagatacttgttgactttatggcaggacacaagttacacattttgcagacttaagagaggctgtgtggcctgaattttgaagtagtacctactgctatagtagtgggcactcagattttgtagaattaggcttatcagaaatcctcagtttaattgtacattctatgcacttaatatttgagatttgttacattgtattggtgtctaatattttattcattccctatgagtgccagaaaaggagtgaaggtagagaatatttcatttgtcagtattccatgaaactactgattatgggaaattcatgaaagagcttacagtttaaaattctacaatggattaattaaatatatatatctgattacagctgaagttcaagtccctcagatcaatcagcagtattttcagagataagtagatttatttcttaattaattaattaatatttatgtgtctattaaatatggttcttcattgcacatactttgaaattttttttcttttttagagagagtgtcttgctctgtcacctaggctggagtgcagtggcgcaacctaggctcactgcaacctctgcctcccaggttcaagcaattctcatgcctcagcctccagaatagctgggattacaggcacgtgccaccatgcccagctaagttttatatttttagtagagatggggtttcactgtgttggccaggctggtctcaaactcgcaacttcaggtgatctgcccacctcggcctcccaaagtgctgggattgcaggcatgagccatcacacctggcccatactttgatatttttaaccatcaaattagtgaataaattactgaataaaacttaaccatatctcttccatgggtagggagactatggcatcacaaaggaacagtgttgttatatctttacaataggaaacattggacaaagatggaagagtaaggacaatgttatcattttcattgttccatcatcataatgtgccatgttgtgtatagacttctctacactgtgtggctgcttctttggaatacacagtcctaagcattgctgggattgtgaatgtcaaactactactatagatattttgtatctcagaacttaaacttgatgcagtaattattgtcttaatcattggttttacccttcctatcattgtgttggaataaggtctttcctgaagtgagtactataagcaatagtatagaaatacacaagagacaataaagtacgtgaggaaggctgggcacagtgggtcacacctgtaatcccagcactttgggaggctgaggcgggtagatcacctgaggtcaggagttcaagaccatcctgaccaacatggtgaaaccctgtctctactaaaaatacaaaaattagctgggtgtggtagcatgtgcctgtaatcccagctacttgggaggctgaggcaggagaatcacttgaatttgggaggtggaggttgcagtgagccaagattgtggcattgcactccagcttgggtaacagagtgagacattatgtatatatatatgtgtatataaatatatatgtatgtatgtgaggaggataatagttaatcctaacagattaacttggaatcattcaataagtagactgaactaaaattgggaagccattatttggtattaaattatgggcaccaggggtaaatgactgactaatagagcaggaaacaccagacagagaaaggaatgaaatacaaatgatggtcagtagggaggaggtggtcaaggaaaatgagttatgaacagaaagaactctatttacaggctgacactataaatgcttgtaaatgaaaaataaaattctaaggcctccagtgaactgaatggaaccctcatcttggccaagggtattccaaagttaacctgaaacactagttcaagccatgacgggaatgagtggtcagacatgcctcattataccctcgtcctgttggaattcagtcactactgaccagcattaacattaaaacagagaccttggccggatgcggtggctcacacctgtaatcccagcacccgcctcagcactttgggaggctgaggcgggtggatcacgaggtcaggagttcaagacctgcctggccaagatggtgaaaccccgtctctactaaaaatacaaaaattagccgggcatggtggtgggcacctgtaatcccagctactcgggaggctgaggcagagaattgcttgaacccaggaggcggaggttgcagtgagccaagatcgtgccactgcactccagcctgggtgacagagggagactctgtctcaaaaaaaaaaaaaaaaacagagtccttaagacaacgaagggagacactgtagcaataagagaccaacatagcagacagcaggccctgaagaaaactgaaatattttaccccaagatatatttctttgacatattttgaaatggccctgcaatggtgtctgttgtggggaaaatccatattctgtaaagaattcccttccttttccaagtctttttcctgatccaggagagaattaactaagaatttggcacctttttaagtctgatgagaaatatttacagtgtattctctctgaagcctcccatctggaggctttatctgcataataaaagccttgatctccacaacaaccgcttttcttaacccagacactcccttctattgattccacgcctttagataaactcttcaactgtgaatccacctatgacctgaaatcccactccccacaagccctcccaaccaagttgagttgtcccacctttccagaccaaaccaatatacatcttacatgtattgattgatgttttatgtctccttaaaatgtataaaaccaagctgtagctgaccaccttgggcacatgttctcaggactcctaaggttgtgtcacgggtatgtttttgaccttggcaaaataaacttctaaattgtttgggaactgtctcaaataccctttgggttactccctgaactatgccagaaaatcattgacattgtgaagggaaaatatcttgggtcccccaaatcactaagctaaagggaaaagttaaggttgggaacctcttagggaaacctgcctcccactctattcagtcacccctcttctcactgagataagcgcatatctgattgcctcctttggagaggctgatcacaaactcaaaagaatgcaaccatttgtctcttatctacttatgacctggaagccccctccaagcttccagttgtcctgcctttccagaccgaaatgatgttcatcttacatatgttgattgatgtctcatgtctccctgaaatgtataaatccaaactgctctgactgccttgggacatgtcatcagaacttcctgaggctgtcatgggctcacatcctcaaccatggcaaaataagctttctgaattaactgagacctgtctcataatttgggggttcatgttttggtaaccacagagggattctaagtagaggtgcccctgacctttgacaaatctccttttggtgtttggtatcagcttgagctatctttatggctcaaaccaataggataatttgctgaggtctggaagcaccctctccagagaatccctgatcttccaaaatttggttgagatctacagtttattttggtacgtaactcctttttttgaattttacttgcttccaacccaaggaaggcaagttttccctgcttccataatgatggaaggcagataactcctttatggagtttgagctcacttccaacagggaagatgagtttttgttgttgtttgtttatttgttttgagacagagtcttgctctgtcacccaggctggagtgcagtggcacgatctcagctcactgcaatctctgcctcctgggttcaagtgattctcctacctcagcctcctgagtagctgggactataggcgttcaccaccatgcccagctaattttttatttttagtagagacagggtttcaacatgttggttaggctggtcttgaactactaacctcaagtgatctgcctgccctggcctcccaaaatgctggggttaccggtgtgagccaccgcacccagcctgatgagatcccctccgctgccccctacttctaggatggtagagagcagccttcagcctgaaatccatccctaggcaagtaaatgatgtcaggcctctgagcccaagctaagccatcgtatcccctgtgacttgcacatacacatcccggtggccggttcctgccttaactgatgacattccaccacaaaagaagtgaaaatggcctgtttctgccttaactgatgacattgtcttgtgaaattccttatcctggctcaaaagctcccctactgagcaccttgtgatcccccactctgcccgccagcgaacaacccccctttgactgtaattttcctttatctacccaaatcctataaaacggtcccacccttatctcccttcgctgactctcttttcagactcagcccgcctgcacccaggtgaaataaacagccatgttgctcacacaaagcctgtttggtggtctcttcacacggatgcacatgaaaaatgaagtggggtttgtcttggttaaagttaagatttccaaccgcctgatcttaatttctccttaccattagagtgcttggtaatcatgtaagttgtgcaattgtttgttttgcttaacttttgttttgttattgttttttgtttctggtttttgttgttgtttcagtctttttctcattgggtttgatcaactctatccaactagatcaaatccaaaggaagttccaaattatggaacaaggcctctgaagtggctaaattcccagaaaaacgacgacaacaacaacagcaacaacaactacaaaaacggtggtgtggtagcagagaaatataccagcaaaaggaaaaaaaagaggaaaggctttgattttgactactaataggctttatttacatagcaaggtggcctttttgctaatcaggccaaactgaaagagcaatggctattacttctgaaatagcagcaatttgtcctagctgaaatatggtaatgatatttaaaaacatattttttaaaggggctcagtggctagtcagcttaattaaaagctaacatccaagatgtgtgtgtgtatgtgtgcatatgtgtgtgtttgtatttaaaagaccctcatgcttttgtttttgcttttctcctaggaccttgtctctttttcgagcaaaagttttttcttctcagttgactgaattctgttttcttcacttgtttgtttctgctctctctcctttctcttgcaccctctgctgcatggggaacctaaaatagttcgtaatagcctggggttccttaaagaaaacagtgaaggcaccagactcccttcggaggagaaacctgtttttccttatggaaccccaagaatgcaaacagacaaggtcctctcagctcttaaactgcttactttttttcactcacgtccgtgtgaagagaccaccaaacaggctttgtgtgagcaacaaggctgtttatttcacctgggtgcaggtgggctgagtccgaaaagagtcagcgaaggcagataggggtggggccgttttataagatttgggtaggtaaaggaaaaagggaggttgttctctggcgggcaggggtgggggtcacaaagtgctcagcgggggagcttttgagccaggaggagccaggagaaggaatttcacaaggtaatgtcatcagttaaggcaggaacaggccattttcacttcttttgtggtggaatgtcatcagttaaggcaggaaccagccatctggatgtgtatgtgcaggtcacaggggatatgatgtcttagcttgggctcagaggcctgacacttttgtattgtgttacctggttttttgtttttgtttttggctaacatagttattgcaacagagtttgctcttgggtttttaaggaagagtgtgttttagacactagaaatgtctttgcttaaaaaaaatttttctaagtgcacttaaaaaaacttaaaaaagtatcatgtggtctaaccttattataattctcccattctggagaccctggaatcagtgtgggctctgcccacagctcagggatccagttaaaagataggtagttcctatctaaataaaactggtctccttatccaatcttacgatagatttctgtaattttatgtttgatttggcatctatctttaatctccctctagcatcaccagactttttctctcagtaccttgtgatgtaaattttgctatttgcatttcacctgagtcgtttcctttaatttgcaaatttaagcgtgtttacctgacaactgcctagggttgtgaaacagattatcaaaaatctgaaagtctaagatagggaaaaaaaggtttttataaatctataagatgtaatttatcagcatgcctaatatgtctatgtatttatatgttatgtacagaatgtttcactactcaaaatagataaaagagctctaattaattggcttaagaaaacaaaaatgcttgaatcaaatactttattggaaaaaagaaaagactagtcaaatgcttattcaagtttatgtaacttaagtaaaatctttaataaataagctagctttaaaattattggtaaagtaatattagaaatgtcttaagaattgccagcatacatttttgttttgtatttattaatcaagcaatttcatacttatccctgtcaaatgctatgaggtgtcaaaatttggcatagtggttacaaaactataaaaccagcccaagaaaatgatctttccctgtgtaatctttaaataaattagagattgatattggtgtaataagctacatcattttattttatttatttatttatttgtgtttttttgagacagtcttgctctgtcaccgaggctggagtgcagtggcacgatctcggctcactgcaacctccacctcccaagttcaagtgattctcctgcctcagcctgagcctcctgcctcagtccggagtagctgggactacaggcgcatgccaccacacggagctaattttttgtagttttagtagagatggggtttcaccttgttagccagggtgatctcaatatccttacttcgtgatccgcccacctcggtcttccaaagtgctgggattacagtcatgaaccaccatgccctgcctttatttactttttttgagactgagtctcactctgtcaccgaggctgtagtgcagtggcatgatctcagctcactgcaacctctgcctcttgggttcaagtgattctcatgcctcagcctcccaagtagctgggattacaggcatgtgccgccgttcccagataatttttgtattttttgtatagacagggtttcgccatgttagccaggctggactcaaactcctgggctcatatgatttgcccgcttcagcctcccaaagtgctgggattataagcaggagccaccaagccctgccaacatcttgaatttagtaagattactgtgacttctaatcttgtggcttttgtcggtctagtccacaggcagtaaggtttgttttgggaaaggactgttatcatctttctttcaaagctaaactataaactaagttcttcccaaagttagttcaaacttttatcaaagccaatttaaaagcctatgtaaaaaaataattattcttgctgagctgtatacaaataatttggccaagtatcataaagcaaatgaatcctatcatgatttgtcttgagtaaaaattaaaaactggagagagaataactgtgtttcaaaacctatactatacctgttgttagattctaggtcttgcctaatgtttttcaatttttattattttctacagtttggaccaaattctaatttttcttggctacaagtcttcaaaataatgttctcatttttttcttcttttttttccccacttttcctaatttggagtcactgaaaactaagctgtgctttcgtaaagccctgtgaactgaagctagacaactcgaacttcagaagaaaataacagcaacctatttacatacataagccactttcctacctgcctccaatgtaaggatttcagagtaatgtggcctatatcaattttccaggattgttcttttgcttattgttgtttttctcccttcctccccctattttatctttaaaggatatgaagcttcacaacttctaaaaaatgagctttcctaataactcaggacctatctgcctaggaataacccattgtacccatgagaaattagaggaaatctgagatcagagactcattttcttttaacatgttttctccaaagattttaaaaaagaaaaggggggaaatgtgagagaaaaatatcctgcccccccaaggttactaaactaaagggaaaagtcaagctgggaactgcttagggcaaacttgcctcccattctattcaaagtcaccccttgctcactgagataaatgcaaatctgattgtctcctttggagaggctaattagaaactcagaagaatgcaaccatttgtctcttatctatgtatgacccggaagtcccctccaagcttccagttgtcctgcctttccagaatgaaacaatgttcatcttacctatgttgattgatgtctcatgtctccctgaaatgtataaaaccaaactgtgctctgaccaccttgggcacatgtcatcaggacctcctgagactgtgtcacgggagcaagtcctcagcactggcaaacttactaaattgactgagacctgtcttagatttttggggttcacaacattcattagcgattgggggtctaggactgaaatttaaaggcatagatgaagtctgacagatccaatctgatgttaactttgggattttctttagttaccactcagtgccccagtcctccttaaaatactttatacctccaagtctctttccttccataaaagccaattgtttctctaacactaggtctctgccttgctgttacctgccttcagaacctggggtcttcccttcatagttagggttcccaccagctaagaattcacggcctggatctctgcatattgcctatgctcagattgccttgctgccatgtcccacctatcctgtcacacttttctcacctggagtttgatggtttccttgtcactcttcctcccttgcagtgtgctctactttgcttctctgggcagacccttgcataatcctgggtctgcccctatatgcctctagtaggagttgatgctgggcttgtattttggatagtcccaatggtaaataaaccctgactgtcgttcattcatctgtcaaatatcattatgctctaccatgtattaagcattatgctaggcacttgagatataatgagagaaataaccatggaggaacacaggaactctcatacattgctgcaatttggcagtatattgtaaagttgaacaggtacatgccctactctgcagctaattaatgtctcggtatctacctataaagactcttgtttctcctcatttacttcatttgcttttctttcatttacaacatattatgtaggacatactttttttttttttttttttttttttgagatggagtctctctctgtccctcaggctggagtgcagtggagcaatctgggcttactgtaaccgctacctcctgagctcaagtaaggtggaggttgcagtgagcccagatcctcctgcctcagccttctgagtagctgggattataggcacatgccaccaagcctggctccggtacatgacttcaggtgatcctgacctcagatgacccacccacctcggcctcccaaagtgctgggattacaggcatgagtcactgtgtctggctgagcatgcaaaatttgtaatcggtagacattgtttataggcatgtttcataattataaaatgaattaaaaatcagtcacataaatatatgggctttttcaaaataacccaacatggaaaccttgatatccttccctagatctatggcagtctttgtagtctccatgacattgcacagcttgggttcagaaatgactctctagaaaaactgaaacaccacacctctgtagataatgatgtgcagctggggctcagccacttgtgttagtgaagttcctttcacaccaaagatactcaccccacttccatattatatccaatcatagtatttcaacttctgtcaaaattcccagtctccaactatggtgcagcagatcctttcaaatgtaaatacaatagcataaacttatatactgacaattctgtaacatacagaatttcattctgtatgattctatttaatagagtttcaaaatattcatatggatgaccataaaagaaagtaagattaaagatgtgctctttatgaaaaggtgtaacccacatttcaatcagggatactttataatctttaaaaaacacaccattgaccaggtgcggtgactcatgcctgtaatcccagcactgtgggaggctgaggcaggtgaatcacctgaggtcaggagttcaagaccagcctggccaacatggtgaaaccccatctccactaaaaatacaaaaatgctagccaggcatggtggcaggtgcctgtaattccagctaccagggaggctgaggcaggagaatcacttgaacctaggaggcggaggctgcagtgagccaagattgcaccactgcactccaggctgggtgacagagtgagactctgtctcaaaacaaacaatcaaacagccacaccatcggccaggcgcagtggctcatgcctgtaatcccagtactttggaggttgaggtgggcagatcccttgaggccaggagtttgagatcagcctgggcaacatggtgaaacccagtctctactgaaaatacaaaaattagccgggcatgatggtgcatgcctgtaacccagctactagggaggctgaggcacaagaatcacttgaacctgggaagtggaggttgcactgagccgaacttgcgccactgcactccagtctgggcaacagagatagacgctgtctcaaaaaaacccaaaaaaccaaaaacaaacaaacatacaaacaaaaaacaccattgtttttatttgtattttttccctatttactacttccacaggaaaattgtttgatttttgctctattttaagccaaacttcatatgcagggtaaggctgaggcaaaacaagtgagaaagtggttgtagataaatgtaaacgaatgaccatgagatgaccctttcagaacttgtgcaacacgtatgtcaccagccccattagcctgtgttaggaataacgttcaaaatcctaaggaaattgaacactcgaacaaaggattcttagcaaagcaattttacttctgcgcacaggggtgcctccttggccagttacatgagagcacacctgaacaaaggggcaggggaacctttatttctgtcgcaagtcctgccccgtacgctttttttattggccagggtcgggtcgtacaatttaaactaatctcggttggctaagcatttgattttttttagatagggtgggcacgtacaagaaagtggagaggaaggctggacgcggtggctcacgcctgtaatcccagcactttgggaggccgaggcgggcagaacacgaggtcaggagattgagaccatcctggctaacacggtgaaacctcgtctctactaaaaatacaaaaaaattagtcgggcgcctgtagtcccagctactagggaggcggaggcaggagaatgacgtgaacccaggaggcggagcttgcagcgagccaagattgcgccactgcactctagcctgggggacagagggagactccgtctaaaaaaaaaaaaaaaaaaaaaaaaaaaaataaaggaagtggagaggaaggggaagggttgtctgcaatgagctagaaagttagtctttttttttttttttaaataaggaaaggaatgcgaggtggtactgataatgcctggtactgtagcgtgcctgggcattaaaggagaaaaacggaaaaacggcgggggtactatgaattaaagaataaaagattgatcagattatttgaagagaaaccgcatcatatcccacacctgtcactacataatgaggttatgcttcatttttatatgtatataattatgaaaaaagactctgtctgtttgcttaccagatgttagcatgtatttttctacaacattgtttggagcgtttcctagagtactgcttggctttttgttcaggagccttgctgcagctgggtccttccttgcagccttcccaccctgctgactgacaggatgctacctttattgctgctgatgtttatcagactgatactctgcctctaattgcaactggcattgtctctccagctcacaggaggggaaactgttcttgtaattcttcgtaatacagttgaggcccggctaggaccttggccaggcttgggagtcatagggtttgcaaactcaaatgtcaacagaagtctggctggtaatggaagcgtgaaggctgcatagtttaagaaatgtgggcatgccatttggctttaatgttaggaaataacagccagtggccaggcgcagtggctcacgactgtaaccccagcgttttgggaggccgagatgggcggatcacgaagtcaggagatcgagatcatcctggctaacatggtgaaaccccgtctctactaaaaatacaaaaaaattagctgggcatggtggcaggcacctgtagtcccagctactcgggaggctgaggcaggagaatggcgtggacccgggaggcggagcttgcagtgagctgagatcacgccactgcactccagcctaggcgacagagcgaggctccgtctcaaaaaaaaaaaaaaaagaaaaaaaaagaaaagaaaagaaaagaaataacagccagtatgagtgaactgacgacgacatactgcatttaaagggagaagctgctattcaaagccaactgattgttgatatatggaaacagggcttagtttttccagttacgattttgcaaaagaactctgcaatttatattttttaagggaaatattcttatttttcaatactggcaactaattctttttttttttttttttaaagaaagtgctgtggccaaaccaaatatttctgtgggcctccatagaactatgaaacactaatctatgaccattgactaacaactgctaccggaagtagttacttgctactcccaggactcacagtccaactatcttttagattccctgcatagcaaccggcagacctccatgtagcatgagctgacacagacagacatacagacatacacacacacacatgcacacgcacatttacagagtgcatatgaatgaaaatcccatttatatcaggagaaaaacccacatcctccccaatattggtgttgggctccacagactactcaaagccatcactgtggtttgcccatttagtctcaaataacactttatgtggaagagaaatgttacattatagtccatatgccactgcgtcaaatccaatgcactttgcattcaatcttgccttcaggatgaggtaaagaaaagttgctactgtatgcatggcataatctcatctcctatctcctggaagcaaatggttaaacaaaaattataaacacaacttccaagaacaaaatagtaattttcagtagcaagtagcctgaattcagatttaagataaactatgtctaactctgtggaggttcagcctggctaataaatcaaatttacattaaggtcagggctctggtgggactattcccttatattcaggagtgtcttcaagaataatggaaagctacttgagtacaagagtaaaagggcccactcaatttccacatcagaatgcgggaaaaccacatgccatattctcattggaaacttctcctgcttcaaaatttaaagttcattctgcaccagataatccatttgattaaaagaaaacaacttctgagggctaacctgttaaataagcccacatccaaagtcatcttaaaggtgactatcagagcaataaaatgaaacagtaaccctgcttgaaggcaaaacaaatttgaagaacaattcagccagaggtagagtcttgaagtctaacaccagctgtaagaaatgaacactatgctggagaagaggtgagagatcaggctaccttgtttttgagtaacctagcatgtagatatctattgtgcaggaagatgtatcaggtaccttggaattacagaactaatgtctatggtgctgaatttatgctaagaaatattctgataatttaattttcccattaagaaaaagtttgctggtcaacctgaaaaatatggtctatttggccagattgacaatatttctcattataaattaacaaataagttttctggttatatactttagttacacaaatatattgtgtaattgtatgatatgattacattgagagggtctaaatattttatatacttaagaaatattaggtaagttgattttaaataggcattacagatggcaacataagtaaattaaaatatcaccttatacagtcaactcatttttaacttttctttattcatgcactggaaacatgcatttttatttttatttctcaaactattttttaagattaaatgaattcatttttctttacctgcagaaaattgccctgtcattaagaaagaggaagaagagaacattcatatttattgacagcattgtttggcctcttatatatataaaatgtcatttgttttgcacaataaccctggggaaaaaaggtattctccctgtgtaataaaaataggttgaggcatgtttagtaaaacatgccctaggtcacacagctagtaaattgtgggctaagatgactcttttattctttatgatttttttattggcacattgtagcctaaaattctaaaagaacatataatcttgtgtgctactaaaaattttaatctgctctacccaaggtttaagtagtatttgaatgagccagattgggagaggccgtgactcagtcagagtcagactgtcagacttgcagtgttgtttggaaagatgggtttctgagatgggcattaggccagggacatcaggcttcaagtaaatctaaaatctaggagattattctttgtagggtagaggagacgcaaaggacataggcttaaaataagcatattaacctgtgcagctgcattaatgagtgcggcttcaaaagaatctcttcagtaacagagaaaataatgactatattcatacatagtaggccattgacagaagacccaggaataagatcagccatatattgtatctgaaatatggctaaagtgtaattaaatatttaatattaaactaaactcatatagaactgggaaataagaccatcaaattctcagttattgttatctctgaaagtggctttgtttagttgataatttgactagggttagaattataggtccaaatatatacatatatatatatacacacacacacgtatatatatatatatatatatatatataccgtgtatatatatatatatatatatataccgtgtatatatatatatatatatatatacactttttttccaactcaatattttgctcaagtgtttaattgcaagtagtatgctgatgaaaaatctgttgttaatcttgttcttattttcctgtaaggaatctttcttttctctctagcagtgtcagaaatttcctttttatacttagtattctaagatttcaccatcttgtacctgtctttttaattttgcatggctttcactgacccattatgtagtttcatgtctttataaagttctggacaattttaggctattacctcctgaaatattttttccctacattctgtctaaatctattgaaaagagttacgagtgggtaggtaatttggtgactggtctcttggtatgacagcatctcattccttttggtgtcaccaactctctaatacactgccctatttctctgcaataagaactgtattcatctttcctttgtggagatagatattgctatttgtcttataggagggagaggagagagatactcaggggctgacctgtctgggttctccctttgtggggctccaactaatcatcctgccaatggcttttgggtacccctcctgctcctggatttcattccttccaggcatggagcatttatcttgttggtctcacctcctgggttagaacttttctgaaggaatcatgggctgtgacctctttcttttctgctcatatttttcaaagactaattattatttctgtcgttttcaccatagatatttttatttatttaaaaaataaattttccttaatttttatgaatttagtgtaagaggagggattatattaaatgctcaccattttaaaattagaagtctgtcttctatctttccttcactaatatgtgtgttttgtacttagtcatatggtcaaatacttgtacataaaattatctgaaaaagcaaatgaaaaattaactagatttccccgtcgtatttgcatgtattccttacaaacttacctcagtcttcattttttcctgctctgtccattttcatccaaaacatacacatatacatcatacagtcaagataagcatgcatatatcacaggtatctttaacacagtttgaagatgtaacccttcattaaatgatgatggagaaaaaataaaggtaaacttagagggtatagttgagagacagtattaaaacaattgacttttaaccttattggtcttgattatggaacggagatgggtgaatcgttcatttagatttttttttttttttttgagacagagtttcactcttgttgcccaggctggagtgcaatggcacaatctcagctcactgcaacctccgcctccctggttcaagtgattatcttacctcagcctcctgagtagctgggattacaggcatgcaccaccacgcccaactaatttttgtatttttagtagggacggggtttcaccatgttggccaggatggtctcaatctcttgacctcgtgatccacctgccttggcctcccaaagttctgggattacaggtgtgagtcactgcacctggcctcatttagagtttatgttatttatttatagcttgataatattttatcttttaatttttattattgtctaaatattcagatttagaggaaatattattttcttcaggcaaaataacagtcctgagaggcaaagtttttttgcttcttttttttgagatgcagtttcactcttgtcatccaggctggagtgcaacggtgcgatctcggctcactgcaacctttacctcctggattcaagcgattctcctacctaggctcccaagtagctgggactacaggcacacaccaccatgcctggctaatgtttttttttttttttttttttttagtagagatggggttcgagaccatgttggccaggctggtctcgaactcctgacctcaggtgatccacccgcctcagcctcccaaagtgctgggattacaggcatgagccgccacacccagcctgcttttaaaaatattatttttaagttattagtagaatggacttattgaaatatgtactttttaactgaaggtacttggcatagtaagtttaactatgtttaactctgttgatttgcttttacattttgtgcaatcataagtgtccttcagttcttaaatatccacagcaaatcaaatattaactctgtgcatgtttttgagtttttattaagtagtgtttatatcattgtacctattcttatagctattgcctacatccaagtaggcattttgtttagttctttttctttagtctctcgaaataatgaaaagtgaaaatttctataatttgattgactgttttaagtctttaagtatattacactttgggcaaaatgcctactactgataaagacagcaaagtttttacagatgtataattaaaaactgacaatgcagtataatggagaacacacagaaagttccctttgtagtagtaaaaatgttggtatgcatagaggtgggaacttcaatgtgctagtgtggagggagtggtgtggaagtggtatgccataagtgtggaaaggtaggtaggaaccggatctttcctggccttataggttataataaggatattagatctttttctcaagccaataaggaattttaaaataactttaaagaggggaatggcatgattagtctatagttttaaaaagtcactctgccttcattatgggaaatacattgggggcagagggtatacaaatgcacatagggaggaggatgtgcattgaaacatatacatttgtgggcacaaaataaatattttgggatattggcagattggctaactctattctcttcagacttcttttcaatattttctgaaacgtcaccatggacaaataataattaataattaataattcattaattaatcattaatacaggaggttccaagatggccgaataggaacagctccagactgcagctcccagaagatgggttatttctgcattttcaactgaggtaccaggttcatctcaatggggcttgtcagacagcgggtgcagcccagggtgcagggcggggcatcgcctcacccaggaagcgcaaggggtcagggaattccccttcctagcaaagagaagccatgacagacagtacctggaaaatcaggacactcccaccctaatactgtgcttttccaatggccttggcaaacagcacaccaggagattatatcctgcacctggcttggagggtcccttgctcactgctagcacagcagtctgagatcaaactgcaaggcggcagcaaggctgggggaggggcgtccgccattgctgaagcttgagtaggtaaacaaagcggccgggaagctcgaactgggtggagcctaccacagctcaaggaggcctgcctgcctctgtatactctacctctgcgggcagggcatagctgaacaaaaggcagcagaaacttctgcagacttaaatgtccctatctgacagttttgaagagagtagtgcttctcccagcatggagtttgagatctgagaatggacagactgcctcctcaaatgggtccccgacctccaagtagcctaactgggagactcctcccagtatgggctgactgacacctcatacagccaggtatccctctgagatgaagcttccagaggaaggatcaggcagcaacatttgccattctgcaatatttgctgttctgcagcctctgctgggatacccaggcaaacagggtctggaatggacctccagcaaattccaacagacctgcagctgagggtcctgactgttagaaggaaaactaacaaacagaaaggacatccacaccaaaaccccatctgtaggtcaccatgatcaaagaccaaaggtagataaagccacaaagatggggagaaaccagagcagaaaagctgaaaattctaaaaatcagagcacctcttctccaaaggaatgcagctcctcaccagcaatagaataaaactggatggagaatgactttgacgagttgaaagaagacggcttcagacgattggtaataacaaacttctccaagctacaggaggatgttcaaacccattgcaaagaagctaaaaaccttgaaaaaagactagacaaatggctaactagaataaacagtgtagagaagtccttaaaggacctgatggagctgaaaaccatggcacgagaagtatgtgacgcatgcacaagcttcagtagccgattcgatcaactggaagaaggggtatcagtgattgaagatcaaatgaatgaaatgcagtgagaagagaagtttagagaaaaaagagtaaaaagaaatgaacaaagcctccaagaaatatgggattatgtgaaaagaccaaatctacgtctgaatggtgtacctgaaagtgacggggagaatggaaccaagttggaaaacactctgcaggacattatccaggagaatttccccaacctagcaaggcaagccaacattcaaattcaggaaatacagagaatgtcacagagatactcctcaagaagagcaactccaagacacataattgtcagattcaccaaaatagaaatgaaggaaaaaatgttaagggcaggcagagagaaagattgggttacccacaaagggaagcccatcagactaacagcggatctctcagcagaatctctataagccagaagagagtgggggccaatattcaacattcttaaagaaaagaattttcagcctagaatttcatatccagccaaactaagcttcgtaagtggaatggcacaatctcatgcgccaaacaaatgctgacagattttgtcaccaccaggcctgccttgcaagagctcctgcaggaagcactaaacatggaaaggaacaactggtaccagtcactgcaaaaacatgccaaattgtaaagaccattgaggctaggaagaaactgcatcaactaacaagcaaaataaccagctaacatcatgacaggatccaattcacacataacaatattaaccttaaatgtaaatgggctaaatgctccaatgaaaagacacagactggcaaattggataaagagtcaagacccaacagtgtgctgtatttaggagacccgtctcacatgcagagacacacataggctcaaaataaagggatggacaaagatctaccaagcaaatagaaaacaggggttgcaaaaaagcaggggttgcaatcctagtctctgataaaactgactttaaaccaacaaagatcaaaagagacaaagaaggccattacgtattggtaaagggatcaattcaacaagaagagctaactatcctaaatatatatgcacccaatataggagcacccagattcacaaagcaagtccttagagaactacaaagagacttagactcccacacaataataaagggagactttaacactccactgtcaacattagacagatcgagacagaaagttaacaaggatatccaggaattgaactcagctctgcaccaagcagacctaatagacatctacagaattctccacctcaaatcaacagaatatacattcttctcagcaccacatcccacttattccaaaactgatcacatagttggaagtaaagcactccttagcaaatgtaaaagaacagaaattataacaaactgtctctcagaccacagttcaatcaaactagaactcaggattaacaaactcactcaaaaccgctcaactgcacggaaactgaacaacctgctcctgaatgactactgggtacataacaaaatgaaggcagaaataaagatgttctttgaaaccagtgagaacaaagacacaacataccagaatctctgggacacatttaaagcagtgtgtagagggaaatttatagcactaaatgcccataagagaaagcaggaaagatccaaaattgacaccctaacatcacagttaaaagaactagaaaagcaagagcaaacatattcaaaagttagcagaaggcaagaaataactaagatcagagcagaactgaaggagctagagacacaaaaaaacccttcaaaaaatcaatgaatccaggagctggttttttgagaagatcaacaaaattgatagactgctagtaagattaataaagaagaaaggggagaagaatcaaatagatgcaataaaaaatgagaaagaggatatcaccaccaatcccacagaaatacaaactaccatcagagaatactataaacacctctatgcaaataaactagaaaatctggaagaaatgtataagttcctggacacatacgccctcccaagactaaaccagtaacaagttgaatccctgaatacaccaataaaaggctctgaaattgaggcaataattaatagcttaccaaccaagaaaaatccaggaccacatggattcacagccaaattctaccagaggtacaaagaggagatggtactattccttctgaaactttcccaatcaatagaaaaagagggaatcctccctaattcattttatgaggccaacatcatcctgataccaaagcctggcagagacacaacaaaaaaagagaattttagaccaatatccctgatgaacatcgatgcaaaaatcctcaataaaatactggcaaacccaatccagcagcacatcaaaaagcttatccaccatgatcaagtgggcttcatccctgggatgcaaggctggttcaacataagcaaatcaataaatgtaatccatcatattaacagaaccaaagacaacaaccacatgattatctcaatagatgcagaaaaggcctttgacaaaattcaacagcccttcatgctaaaaactctcaataaactaggtattgatgacaagtatctcaaaataataagagctatttatgacaaatccacagccactatcatactgaatgggcaaaaactggaagcattccctttgaaaatcagcacaagacagggatgcctccctcaccactcctattaaacatatcattggaagttctggccagggcaatcaggcaagagaaagaaataaagagtattcaattagacaaagaggaagtcaaattgtccctgtttgcagatgacatgatcatatatttagaaaaccccatcatctcagcccaaaatctctttaagcgataagcaacttcagcaaattctcgggttacaaattcaatgtgcaaaaatcacaaggattcctatacaccaataatagacaaacagagaggcaagtcatgagtgaactcccattcacaattgcttcaaagacaataaaataccaaggaatccaacttacaagggatgtgaaggacctcttcaaggagaactacaaaccactgttcaacgaaataaaagaggacacaaacaaatggaagaaaattccatgctcatggataggaagaatcaatattttgaaaatggccatactgcccaaggtaatttatagattcaatgccatccccatcaagctaccaatgactttcttcacagaattggaaaaacctactttaaagttcatgtggaaccaaaaaagagcccacattgccaagtcagtcctaagccaaaagaacaaagctggaggcatcatactacctgacttcaaactatactacaaggctacagtaaccaaaacagcatggtactggtaccaaaacagagatatagaccaatggaacagaatagagcccccggaaataataccacacatctagaaccatctgatctttgacaaacctgacaaaaacaagaaatggggaaaggattccctatttaataaatggtgctgggaaaactggctagccatatgtagaaagctgaaactggatcccttccttatactttatacaaaaattaattcaagatggattaaagacttaaatgttagacctaaaaccataaaaaccctagaagaaaacctaggcaataccattcagggcataggcatgggcaatgacttcatgattaaagcaccaaaagcaagggcaacaaaagccaaaattgacaaatgggatctaattaaactaaagggcttctgcacagcaaaagaaactaccatcagagtgaacaggcaacctacagaatgggaggaaatttttgcaatctacccatctgacaaagggctaatatccagaatctacaaagaacttaaacaaatttacaagaaaaaaaacaaacaactccatcaaaaaatgggcaaaggatatgaacagacaattctcaaaagaagacatttatgcagccaacagacacatgaaaaagtgctcatcgtcactggccatcagagaaatggaaatcaaaaccacaatgagataccatctcacaccagttagaacagcgatcattaaaaagtcaagaaacaacaggtgctggagaggatgtggagaaataggaatgcttttacactattggtgggagtgtaaactagttcagtcattgtggaagacagtgtggtgattcctcagggatctagaactagaaataccatttgatccagccatcccattactgggcatatacgtaaaggaatataaatcatgctgctataaggacacatgcacaagtttgtttattatggcactattcacaatagcaaagacttggaaccaacccaaatgtccatcaatgatagactggattaagaaaatgtggcacatatacaccatggaatactatgcagccataaataaggatgagttcatgtcctttgtaggtacatggatgaagctggaaaccatcattctgagcaaactatcgcaaggagagaaaaccaaacaccgcatgttctcactcataggtgggaattgaacaatgagaacagctggacacagggcggggagcatcacacattggggcctgtcatggggttggggaagcagggagggatagcattaggagagatacctaatgtaaacgatgaattaacaggtgcagcacaccaacatggcacttgtatacatatgtaacaacctgcccgttgtgcaaatgtaccctagaagttaaagtataaaaaaaaaaaaaagaacaagaactccaataacaggccttgaaaaactaagcgtgaaatccaggttgtggaacgtttgaccccaggaagaatgtatttcatctgtgtgtagttcatctgtattcttgtggtaatcaagcagacaccagctagaccactagttggcccactgctcaagacagtcgtcaagaccagacatactaccgcacacgtagtcaactcctgtgcttcccataaaaaccgtctagctagcctgagaaacttgagatgatctttgtgacatgagtccaccatctcctctggttgtcaactcctgaataaacccatttttctccctcaaaaaacattaataattattaataataaattaacaataaatcattaacaataattaataattaataataattaataataaaaattaataaaaataaaataaaataaaagtattaaaaactctaataaaatataatacaatataatatataatacaatacaacataatatgtgttatggctaaggaaatttcagattaggaaggacacctaatttagactaaaagagaacagcttcctagagaaggtgaaagatgagttaagtgctgatagctggatagttcagtcagaccaagaaagaatggcttttctgaatcaaagaagaacatttatgtggatatcctgataaaacggaaaacagatcagagtacaaagtataccattaccagggatgtggctgaagagataggccgacaagatattagatattatgctaaaaatccaggatttatcctgaaatggtgaatggtaattgaaagatttttagcaagacagtgacatgatgaaactggtatttcaaaatgaacatgctagcaagaggtgggataatgtactggatgagaataagacgggaagcagagaggcccattaggaatttgattcatttattcactaatggtgataccaaatgcttagtatgtaacaactattgagccaggtgttagggacacagtggtcaacaaaaaagagggccactgctttccttcaaaggtttaaaatctagcacatcaataaaataatacagggaggtaatccagcgcttgaccattctctccctttaaaaattatgtgtgttactttattataatttaaaaatacagatgaataagaagaatgtgaacaaaatcagacatccactcaacctctatggaatgttaacattttattgtgtgtacatacttctagatgtttaaaaatatagtatgtgtatatattgtatatcatacaattatatgaataaatcagactgttctcaattggtttatgatctagtttcctcttaacaacacatggtgatctttccataaccataaatctatttatccatattattttttatgaggggatgatgttctactgcattttcggacattttaggtaggactattcaaaacaatgttagaatgaatattcttataggcaagttttaaatttcatttcattagattaaattcttagaagtggaataaaagaaaatgcacattttaaaggcctttgataatgccccaaaccctcctttataatcttttcttctggcttccataccatactttgttaggttttttttttttttttaactacatcagcaactcatacacagtcttcttcattagttcattgctgcacattgaaatcatctggggatttttaaaaattactgatgcctggctcccacccttagacataccaatttcattggtatgtggtacaatctgggaattggaatttttagaagtgcctcaagtgattcttacttgcagcaaaagatagaaaccactgtattcttttattttccctgtttactacagaaatttaagttccatcctagatctgcatcttaccttttttcacatgctcttcatatgtaatcataatttcacctcttccactctaaactctatgaatataattaaaaactcgtatcttgcacttttcctgaggtccagttccactttgttcattgcctataggaaagtgtgcactaatgctaaatatagaattagctctcaaacttggtgtatctcaaactgaattaagaggtctcccttactcttgataaacagaaaactaaacacatgtttaaaaaaacagcaacacctgtggggaaagatattttctacctttcagttggttgcaaagctcttgtcttgattctttctctaaaacatattttaaatcagtttcccctaccctttctattaccattaccacaacctctaccctcagagtagtaccactgtgacaatacttatctgaatatctgtcttgggagcactggcctgtcagagtagtttgcctgcaatctcacttgcatgaagatagcacctagtgaataccagtagatatgacattagggactgaaatcaaggtggaattaaaaatttcaacacatgtaagtaagagtgtgtgtgtgtgggaggaagtgggataatgtaggagaagggacagtgatcatttccaactacttgaagatggccactcttgggccaggaactcagcccagggttggagaatgttgagatacatcgggctcatcccgattgatttcaggctgcaaaggtcactttgagaattaattgacccaataatggaggaacaactataacgttccaggagaaagaaggctaaaaagcaaaactattttatttgtgttataaatatctgaatttttaaaaaatttgaactccttacccaggcaagtctgccataatttcaaccaaggaatactgacaaatctagaaattgagagatttataagctactgaatctaaaatatggaagcagctaagctgacatgactggggaaagtgaggatcctttaatctctgactgtgagggtgactgtccttgacatgctgtgaagagtagctataaaccatcacttcttgtttctcagatctcaaactattgatccactcagctaaaataaaagctccattgagcagaggccttgattgtacaattaattattctccagcagctctgagagtgtgagatatatggtagccatacaaaaaatattgagttaataatttctcatactggggccaaaacccctgtgaccatagtagcaatgtagtagggtgttcaagtgtgttacttctttagaattttagaaatgtaatttaagaattttttttttttttttttttgagactgaatctcactttgtttcccaggctggagtgcggtggctcgattctggctcactgcaacctccgtctcctgggttcaagtgatttgcctgcctcagcctcccgagtagttgggattacaggcgtgcgccaccatgcccagctaattttgtatatttagtagagatggggtttcacatgttagccaggctgatctctaactgctgacctctggtgatctgcccgcctcagtctcccaaagtgctgggattaacaggcgtgagccaccactcctggcctaagatcattttaataagatttaagagacactaatttctgtctttcaagagaggtactaatttccatctaagcaggcccaccagaaagtagatatggaaaaacaggacaagcatataatatttgtaaagcaaagcattttatttctagaggaagatttgaaatccatggaagttaggagataacacagttgttttagttatttgtcacactttaaagtcattgtagcagttaggaaatagtgagatcttggcaaacaaaatgtggacatctaggagaagccaaagagttggcaacactttttaagcatctctggcagctcctgtctagttggactaaaggaataccatatcctattataaatcacatttccctggaactcagcttaaagggcaaactttagaaggaaaacctccatcatcctcattcaatacttcagctactgtttcttatccgcatctaaacaaaggccattaaatagagtttcagggaaaggcagagctgccaggaatgatgcagagatggcctttttctttagtaaaccagaagcttaaatgggcatgactccataagattttttgttttagtaattagcaaatagagtttcaaattcaaattgacttgaagcaagcagaagttttaaattaattaaattttccaggaaagggaagcctagccctaggaacagagattactcaacttgtaatgcattcctcaggcctaagtatccacacctataaagaatgacttggacttgcaaaggtaatagagctacttaagaagaatctctccaacatccctctgagaagcagcccagaaagatacaaggcaagggaaatctttccagggagaagaactcaaggtgctgaatggcttttaaaggacatttctgagccgggtgtgttggctcatgcctgtaatcctagcactttgagaggtcaaagcgggtggatagcttgagtccagtggtttgagaccagactggtgagcatggggaaatcccacctctacaaaaaatacaaaaattagctgggtgtagtggcacacacctgtagtcctagctacttgggggctgaggctggaggatcgcttgattctaggaggttgagggtgcagtgacctgaggttgtgccactgcacttcagccttggcagtagagtgagaccttgtctcaacaaaacaaaacaaaacaaaacaaacaaaacaaaacaaaacaaaacagcaaagacactttctctatttccaagggagcaagtcaagaacattttatactgcctgctcctaacaagtgattattctcaagcccctttctttcccctaaatgagataattttattaaggtaattctgtctgtggtgcacctttatttgcccctctgaatccttctccacgctccaccttcctctacctgcaatgctatcctgggaggctgacctgcatgaaaaaccttaaaggattcttacctcctctggcttccagttgggttcagccaatggcacagcagtagataagaaggaggtggggcgggcgcggtggctcaagcctgtaatcccagcactttgggaggccaaggcgggcggatcacgaggtcaggagatcgagaccatcctggctaacatggtgaaaccccgtctctactaaaaatacaaaaaaaaaattagccgggcgtggtggcgggcgcctgtagtcccagctactagggaggctgaggcactagaatggagtgaacccgggaggcagagcttgcagtgagccgagatcgcgccactgcactccagcctgggcgacagagcgagactctatctccaaaaaaaaaaaaaaaaaaaaaaaaagaaggaggtgggaggctaggagctaggataagggtacttatcttaagcctccgttcctgtgtccctcagctgaaggtcactgctcatttcaggccaaatggcttcatgggactctccctcctttagtaaccgctggccgaggggcaatagctcagctactacaaaaccccgagctcttgaattataaatcagaattaccctacgtccacacttaatttccttcttgaaatctactctctacatagacaagtgaattttcccctccctgaccaaatcaggcctccaaatataagcttttgtagcttgcttaaattcttgattaatttttactattaaatgattagtttgaattctcccttcctctcacagaatgtaagtttcacgagagcagaaagtgcattagtgttgttctcagctgtttgctcaaggtttaaataaaaacttaaacatagaaacaaaaatttttctttttagttgtgctttctattttttcttgggaccctgatagacagaacagtgaaattcatcatctaactgaagattgcagtattttggaacttggcattaaaagcctgactcaattacactgaaggagattgtacatctcacagaaagcttggacttgagcactgacctccagacactacctgagaaggtctagtagacatgattttccattggagaggtggtggtgtttttgatggcatgtagattgtgactggcaggggcatttttggaatgtaagcatgtctttgagtatgtgctaggtaaaattgaagagtagattgtagtgagcctccactgtggttctgctttatgccaataatttttcttttaattttctattcataaaataatctgcattaggacttttgccaattcagcagaattatgtcattaatacaaaggattataatagaacataaattggctggcccatgcatgaaatccaaaataatatgagtattcacaattttgacaaagcattcaccttaagaagaggcaaacaagcagggaactaatacagatacagttaggtttggtagaacactgatacttgtgatatttatgacataatcatggttctttttgtcataatatggtattttatatagctatttacttaagtgactatatgcatatgaactactaacatttttcacattttctctgcccatatttgggctgctcaataacagatagaaatgttatagttaaaaagaaaattattggccaggtgcggtggctcatgcctgtaatcccagcactttgggaggccgaggcgggcggatcacgaggtcaggagattgagaccatcctggctaacactgtgaagccccgtcttactaaaaatccaaaaaattagccaggcgtggaaggacatgcctgtaatcccagctacttgggaagctgaggcaggagaatcgcttgaacctgggaggcggaggttgcagtgagccaagatcgcaccactgcactccagcctggatgacagagtgagactccgtctcaaattaaaaaaaaaaagaaaaaagaaaattattatctggctgggtgtagtggctcaacctgtaatcccagaactttgggggctgaaggggtggatcacctgaggtcgggagtttgagacaagcctgaccaacatggtgaaaccccgtctctactaaaaatacaaaaaaattactgggcgtggtggcaggtgcctgtaatcccatctattcgggcagctgaggcaggagaatcacttgaacctgggaggcaggggttaccataagctgagattgcgccattgcactccagcctgggtgacaagagcgaaactccatctcaacaacaacaaaaaaaaaaaaaaaaagaaagaagaaaaaaagaaaattgttacctattctccttagataaccctaatcttaatctagtaatactgtatcctttttgagaagatttcagctgtatcctttttgagaagattcagctaaaggttaattcagctaaaggttaacttcagctaaaggttaattggttaacgtgacatattacgcttaaaaatccctaaatgagtcgttttaaaaacctgtctttccctctaatagccagagtttctttgtgctattgtgttactttctgattcatccgagtgatgcttgagaatgccaggaaaacaataaaaacatttcttgccactgagccctacctttgcctggaactcagtgaacatcctccatgaggtggcaaaattgttctggtattagtttgtagtaaaatttcctgaattaggagtggaaaggaagacaatattatgtaaaactttccgtgggttcacaaaaatgaagtgttatcttgtgttcagatcccagacttagagaaaatgattgtgttttctttttcttttcttttttttttttttgagacagagttttgttcttgttgcccaggctggagtgcaatggcgcaatctcggctcaccgcaacttccgcctcccaggtttaagcgattctcctgcctcagccccctgagtagctgggattacaggtgtgagccaccatgcccggttaattttgtatttttagtagagacggggtttctctacgttggtcaggctggtctcgaactcccaacctcgggtgatccgcccgcctcggcctcccaaagtgctgggattacaggcataagccaccatgccctgccaataaaatgattttgaacatatagttctatattatttatagtgaacatttaatggaggggaagttctgccttcaggaagactatgaatattgggactgtgtccttagtagacttggcactaaaaaaaatcactcatttgacatcacaagattgcacaataaatattggagatgttggaaaggtacaggtacacaatggaatactacacattcgaaatgaagctgtagaattgaatttattgacaaagatgtttataatatatcatcattaagtgcacaaaaagggtaaactatatgctgaaggatagtttgggcagcaagcaaaagaacatctaattcaaaatgaattaaataaatatatttatttttataattatcataattacatttattaatctaattgttctagtgcagaggtaaaataggcttcagggtagactgattcagtgacccaacaatattattaaaaaacaatgttctttctgtctctctgctctgtaatccaaaatatctgctttatctcacagctagttcccccaaataattgtaagatagattccaggtgcaattggatattactacttgctttctcattcatatgctgaagaaagagagaatggcttgttattgctttctgcaaagaccaaagaggaaatttttgaagtctgtagccactatctcttcatttatcattggctagaactgctgatttctaaactgatagctggcggaaagaatgtgattatctttagaccagtcagactcacacattgagttaaaggcaatttctaaaatcagagtactgccatttcatggatagtagaatggaatgcatttggggatttggacacagttaaaaaaatctctatctaatctctctctatggatattctagaaaattaatattgtcatatgatagtatctggacaatgacttacatttctttttaattttcttcctttcactcacatgtatataatattcttctgtaaataagcatacattgttttttgtctctttaacattttatatggaaaatttcaaataaatccaaaaataaagatagtaataaaatgaaacctcaagtatccatcacccagattcaacaattatcaacttctggaaaaccttgttttatgcactgtttgtaataagaaaaaaaaaagttgattttagttaaaaaagaagttaagatctgcttaacattttctcttgtccatagaatataccttaaagcaaatcagtaaagtttagctaaggatagcccaatatttttcctgtcaattgcccaagatctctcttaaattataccccaagtatttttttgaaaatttggtttttctcagtttcttatcctacatatgcatctcaaaaatttggaccgcagtaccccaacatcaggagaaaagcacaaaactctaggagcttgtgtatatgaaacaaagtggctcactaaaagcatagttattttgaaatctcatttttagttttaaagtctgtatttttttttttttactctatctaccaatgtttaatagaaataaaatatttcaaattactcaccattgaataaacttgacactgttggaagatggtccatgttggtcttttggcttcttgtcctctgaggcaccctgacaaatacccctgtgaacacaaggtccccaatttaagagtcatagattatagttttcttcccttttaagactccccttttgatcgttgaccatatttccttgacttttaaacttcattctctttgaggactttgctttgaattcagtcctcttgttttttccattttagacctcctcagctcgtatgccctatcttaggattaatactcactttccagtcctggccaggcctggcccagtactctgcaagaggatcttggacctgtaagtcacaaatatcaaggtactcattcatttactaaatctttattgagtatcaaccatgtttctggcacttagctagtccttggggatactgtggttaaaaaggataaaatctcagtgtttaagaagactaaagacatcaggaacacaaaaaatatttaggcaattataaaatgggcaaataagtgctacattggatgaagtactgcatcctataaagcacaaagcagtatcctaagcagatgagggaagtcttccaggaatgagatgcagtataacaataggaaggaaaagtaagtggtggtaattttctatatttgaatgaaaacttactcttgctcaaccacgaaggatgttttcttagaaataaagggattgtcaaaagcagcattcagtatgggagcttacagtgatgtatctagaggggacaagcatgaagagtttgattactcgggagtgcagtttagaaaataactatgtttccttcacagaaaggaagtgttctgccaggcggagtcattgcttccttttctctcttcccttagtcctttgttttcttttttcttttgttttcttttctattttttctattttttttttttttttgagatggagtctcactctgtaactcaggctggagtgcaatggtgcaatctctgctcactgcaacctctgcctcccaggctattctcctgcctcagcctcctaagtagctgagattacaggcacatgccaccacaccaagctaatttttgtattattaatagagacaggggttttaccatgttggccaggctggtctcgaactcctgacctcaggtgattcgcctgcctgggcctcccaaagtgctgagattacaggtgtgagccaccacgcctgggccagccctttgctgtcatatcacatgtggaacatccctacctgcctctcctatgccttcctacctgaagaaataaattaatcattttcccttctaatctacaaactgtgtattatactgaaacacaatgatactttaaaaaatttaagaattaaattgattcaaattttattttatttttagattcaactgattattttgattacttaatcattaaaaaatgatactgttcagtattcagaaagtttgggttcatttttttctttcttgtttctcaataaaagaaatgggtagtggtagtgatgttggcatttgttctgaaagataaatgtgacatgatactcatttcctgcctggcgcggtggctcacgcctataattgcagcactttgggaggctgaggcaggtggatcgcttgagcccaggaattcgagatcagcctgggcaacatagcaagaccgcatccctaaaaaaggagtacaaaaaaaaattagccagtctcataacttggcctgaaaataaataaataaataaataaatagactcatttcccattgagtaatccagaaagagacacaccctgaatggtattgcctaggttttcttctagggtttttatggttttaggtctaacatttaagtctttaatccatcttgaattaatttttgtataaagtataaggaagggatccagtttcagctttctacatttggctagccagttttcccagcaccatttattaaatagggaatcctttccccatttcttgtttttgtcaggtttgtcaaagatcagatggttgtagatgtgtggtattatttctgagggctctgctctgttccactggttataggaattggcaaggacttcatgactaaaacaccaaaagcaatggcaacaaaagccaaaattgacaaatgggatctaattaaactgaagggcttctgcacagcaaaagaaactaccatcagagtgaacaggcaacctacagaatgggaggaaatttttgcaatctacccatctgacaaagggctaatatccagaatctacaaagaacttaaacaaatttacaagaaaaaaatcaaacaactccatcaaaaaatgggcaaaggatatgaacagacaattctcaaaagaacacatttatgcagccaacagacacatgaaaaagtgctcatcatcactggccatcagagaaatgcaaatcaaaaccacaatgcgataccatctcacaccagttagaatggcaatcattaaaaagtcaggaaacaacaggtgctggagaggatgtggagaaataggaatgcttttacactattggtgggagtgtaaactagttcagtcattgtggaagacagtgtggtgattcctcagggatctagaactagaaataccatttgacccagccatcccattactgggcatatacgtaaaggagtataaatcatgctgctataaggacacatgcacatgtatgtttattgtggcactattcacaatagcaaagacttggaaccaacccaaatgtccatcagtgatagactggattaagaaaatgtggcacatatacaccatggaatactatgcagccataaaaaaggatgagtttatgtcctttgtagggacatggatgaagctggaaaccatcattctgagcaaactatcacaaggacagaaaaccaaacaccgcatgttctcactcataggtgggaattgagtaatgagaacacatggacccagggtggggaacatcacacaccagggcctgtcatggggtagagggagggaggagggatagcattaggagatctacctaatgtaaatgacgagttaatgggtgcagcacaccaacatggcacgtgtacacatatgtaacaaacctgcatgttgtgtgcatgtaccctagtacttaaagtataataaaaaaataaaaataaataaaaaaaagaaagagacacacccaaccattattgaagtcctctaaggtggggatagaggacacacagttcatcagggctgaggaatagagaatgggaaaacagatgaagaaaggcctgtgctgaccttttccatgccctcccatggatgtgtttttcctgcacgtcaagttatttaagcaaaggattgtttttgtctggatttttttcttttccaacttcagccatttcttttgttctttttaggcatgaaacattaaataaagttattcttaatatgggatattctcccctaagtctttttagatgataaggaaacagcatgtccattccaatagcctgttcaagagttctacttttaataatttgtgtctcatacttccagatagtccacacatagggcaggtcttattatttcttgtgtatttcattataaccttattaggcccaaacaaaataagagtcacgaataggcaggaaaacatatgactgtagtaagctaggtgttgaacaggaaactgtggcttccagagattaaaatagttttgtttgtgatcttagaggaaacccaaaaggtgttcacttaggtctggttttaaacaggcagaacaacttattttaaagtaatatttctggtaattctgcagctactttgtagtgcctctgctgttctaggcattgtgctagatggtatgaggaattaaagatgaataagaacaaagtttccttcttaggagggaatacaatctaagttagcttttctctttatttatttatttatttttctgagatggagtctcactctttcgcccaggccggactgcagtggcactatctcagctcactgcaagctccgcctcctgggttcatgccattctcctgcctcagcctccccagtagctgggactacaggtgcccgccactgcacccggctaatttttttgtatttttagtagagacggggtttcaccgtgttagccaggatggtctcgatctgctgacgtcgtgatccacccacctcggcctcccaaagcgctgggattacaggtgtgagccaccgcgcccagcctgcttttctttattgtaaccaaaatcatttgatgacttccaaacagggcaacatatgtgtcaaatatggtcatatttaaataactatgccaaggttctgcagttcaattaacttcatttaatttggacacttctagtattagaaaaatatctttttttgctatcatccattaaatcatcaatatttttaaagattcacttccatctctctttttaagaatgaggtgttacataaaactataggtaaatgaatttgaaaaagaaagcaagtaaggctgagtgcagtggcttaatgctgtaatcttagctctttgggaggccgaggcaggtggatcacttgaggtcaggagttcgagaccagcctggccaacatggtgaaaatccaactctactaaaaatacaaaaaattgggtgtgttggcatgcaccagtaatcccaattacttgggaggctgaggcaggagaattgcttgaactcaggaggtggaggttacagtaagctgagatcgtgccactgtactgcgccactgcactccagcctgggtgacagagcaagactctgcacccccacccccccaaaaaaagcaaacaagcaagtgcaagtaagactttgtatctctgattagatgttgaacagtgaatgtctcttcccagacaatttagataatttacatacattctttctctggttagccttacagattaaaaaatggtggctttttaagttttaagttgagtgacttatcaaaaatactttaagacttgaagaccaccagtctagaagttagagatgaaatattagaatatggcagtaaacagtccagcctatgaactagaactagattgactgggttcaaatctcagcttagccacctactagtatgagacttgggttaagttaaaaaagcccttgtatctcagttctcttatttttaaaatgctgataacaataatgtttgtaagatgttgtgggcattaaatcaataaatatatgtgaagtgcttgaaaaaaggtatggcataggcaaacactccatagagtgtcacctattatcatttttatgtgagtgtgggacctgctatccaatgacatcagtagtctcccactgtgacataaaaggattgcatacaaagaaatgcttaataaataattcattcgttcaaacaagtatttttgagagcctgaattctagattctggggatagagccaaggaggacaagctgaagttctcagttttaagggactttcatctgaatgaagtaaactgacaataaacaagaggaacaaatatacataaacatattaagcattactacctactttgaagaaaaagaaagcaggctaaagggatagagactaataaggaataataatgggcaagctgttatagatggggagatttacactcttttgaggagatgatatttgagcagagatatgaatgaaatgagagtgaatgctgggaaaatcaacaggaaatgaattctagaaagtgggaacagcagaataaaggccaggaggcagaactgaattcaggggttcaagagtaaacagaaggcccatcgtggcgtgaagtaagatctagtattcgaagatgaggtagaagtagtcaaataattttggatgaataatagatacatttaatgactcaatcaaaatgatgagacatcatgctgaaaggaagcttaagatacatttgtaaataagattataagatgttgagtgggactttttttgttgcccataattgaaaataagaagagctaagtaaccccctttctatgagaagctcttaatagatgccaaatattgaggccagacactgtccccacctactaaagggtatgttacgaggcgaaaaaaattctctcctaccagcaactagcacctagctctggatacgcataaagagaaaactggagagagaacagtgcaagtcagcagacagtgctcacagggaaaggttactcctcttctcaaggggaacagaaggattattatttttttcttgctgaagccaattaatgggagtccatcagagaatgtttagagattgtgtgcgagtttgtgggaaggaagactggcaattcatttctcagctggctggatggtaatttactaaacacaccagtccctctggagctactatggcggagcgggggcgaatgtctccgcggagttgtgtatttgctacctgaagtttaggactcacccctgaatccaaaacagctgctagtcttaacatttctgaaggagaggaaattgctggagtagcttatggtaacagagttagaaggaactgtggttcagagtttgttcttgagaggggttaaattccctcctttatccccatcctggtcttttgtggcccttggagcatttagaagatggtctcagaggttactatggctcaatgcaaaacagcatggtggtaaggaagggagcagaatagctggtagtgaggagacactccagctggggaagcagttaggggcatggtctgctgtcagggtccaggcttttctctgagggattcctcagtgagtgagggggcaaagcaaagacgaagagtgtctatagaaaaccaagcacaccaccagcacagatttctcaacaccaccatctgttagcaatagacaaaactggattgaaccagagaaaaacctaggacactttctcacgcagacatgtaactgattatgtaagatctctaccacctttgtcttctctctctgaccccaaaactagaggagttcagcagcggggagtgaggatggttgtctcagagtcagatctccttccaacttctctactccaagcagtcagcctcacagtttgtgttgagggcaaagaaaggtaatcatatttatgttagtttcacaatccaagttttaaactggacaaaaataaacttcaaataactgaaactggtagaaagttagaagatttgcactttgggaggccgaggagggctgatcacgaggtcaggagatcaagaccatactggctaacacggtgaaaccccgtctctactaaaaatacaaaaaattagccgggcgtggtggcgggcgcctgtagttccagctactcgggaggctgaggcaggagaatggcgtgaacccaggaggcggagcttgcagtgagcagagatcaagccattgcactccagcctgggcgacagagcgagactccatctcaaaaaaaaaaaaaaaggacagttagaagatttgctaggatattcattaaaggacacgagaataagacttgacaatcatgattggaagccttgattagaataaaaaatataactcttttgtatctatgctcttgttgagacacattacatgagtaaccaaacaatgaaacataacactataaaccacagcacatctatggagaaatcaaaatgcactaatcgaaaattataatttcgtgggacattttatttaaatgtaaaatttcatctggcttctcagttttgataaagtagagagtctgtcaattgcttctttcttataataaagtgagtcaatcttccttccatcagcaacatataatacaaattcttcaggcccttgtcaggaatataaactcatactttctcctattccgtttctaaaaaggtcttctaaggaagtaatatttaagaaagttcatctaagaaacattgtaccctttgtctaagtactttgaattctgcctttgaatcaagctagaccactggaagtatatgcacctgaccacaaaaatatatctcctttaaaaatctgtcaccaactttaacttcaaaattttattctcaggcttctttgaattatcataagaaagtttataaaattctcttctatttgttggtaaaaatattgctgatattattcaacgcgttgctcagtgtcatctccatatgagaaatttctccatcaacttagtggcaggaaaaattctctcttgatttgtttctttcttttaaataatgagaattgtgaaactccctaagtttcccttgttattcttgctatcggcaagttcaaagccaaatttgcagctctgtcagagcaagtctcttatacaatatgtacaatgtattccacttcggttttttcttgaatttgaaccttattttatcagtatattttatattttaggggcgttgtctatttgtaaagaaatggagtataggtaaataaatttggttcatgtgctaggaaaagttggttcagatgactgaaagttgatctcctaacatgaaattgattaatctttgaggtgtttttcaaagactacttgcaaaaaaaaagaaaaaaaaaaagagacttaaaatggcccccaaaatgttatcttcattcattagtttaatatcattaaccaggctaaactgtatattccaataaattgaacaataataggattattttaacattattactgtcagttaattctaaaaaccttatctttggtttttattatatgtaccattatatattgaaaagcttagcagatcctcacatcaatgtccagaaaaattatctccagcattatgaagacacttatatcagttgtagaacatcttatagaagaatagggaagagaggtaatattttgggtaagaatgtagcacaagcaaaaggagagtcagtgacagagtagtgacagcttgtctctaaatgctaattaattatattgatcctctttgttttctcagcttaaacaaaataaagtgcatgggtaccttcaaaacaacacatgatagaagggaatggattcacaaatgacaatagctgtgtttacctggacacctagttaattcactagtttaacaatattggccagtctgtaatgtacatcccaataaactgaccaataaaaggattgccttagcattatggaaatatagctaaagtataagtttaagggcttccataaattaatcagattattattatacataggcatttatgtattatcaggtataaaagacatttgttcaagctaggagatattcaaataatgataaaaatcatctatgactagccacctgggaactatacttttctagtttaaagccataagatgcctcattgctttgacattgctaagtataaaaaggactgtagaataatttgttggtgataaaaatgtctgtggtcacattgctattttacttattatgcaatgtaagatatctactgtggatttctaacagactcaagtccacaaatatatttctcctgactgttcctgacattgcacagaatggcacagggaacacagaccaacacacaaaaagaagagtaactctttgaaaacattttcttcacactgtagtttaggacaaaagtattgcagaataaaatttatggttttagaaaaaacagcaacaaaaatttgaatgaaagacaaacttttgctttttcgaacttttggaagacaaaattatgactctaatgtttcattccttcttctttccttgccattcaaatttctactaaagtgtaagatatatcataaaatttgataatatacactgcaatgcccattgagcagactgaacaaaggccattaatatagcaaggaagacatatttttaatatctttagtctgacattcacttgtcctttatttacatatgcgtaatctcttaattttctacaaattgtagcttatactcacagagttttaaaaaaattcatgatagccctctcattttctgtatctacaattctaggttatatattaccctaagtatacaggtccataggcctatataaagaatttatttgaatttgaaatcttgattttgtgaaagaaacaaatgtcttgagattttgttaaaataagtctggcaagtcttggcccaaagttacactgagagggaatctgttttcctttgaaaacaaaagtattatcaatattttcataaaatgtgagtataaaatagaacatagtattattaaaccatattaacatttcattggcagagatttcactttgttaaaggctgtataagaacagcttaatctcataacccagaagtttttactgttattattgcctctttatttttggctaaagtgtaatttttaaatgagtatacagaaacctaatactatatattgaatgactttaagtaaataaatatccatgctattcatcaggataagtgacctagtgaccagaataaaaaggatatatgttggtagcccctagcacagtatgcctcagcacagaggtttcttgggttactgctagtgaatgattccaattcttggccgtctgatcccacacattacataaattccaactcctgcatctgtttaggtgagctgttggctaaatggatatgtaatgaaattaaacaatatttttaaggtgctttttaggatgggttataccccctctttttctcctcctttccttgcaacctgccctctactcattctttttatgcatatttttgagagcctgaatatgctaggaagagggtttcagtctgttaagaattcacaaccttgtggagttgagatacaattaataaaatttctagtataatgaggtaagtattatgataccatgaaagcacagaggagaaacacctactctgttttgtaaggattagggaaagcaatttagagattatacctaacacaaacacacagatatttgcatagtatgtgagcacacgtttaaaaaaatgtaattttcaccctagaaataagacagtagtgattcagcgtgagttgatatgcctgtctccactataatgaaagaaatataacgtcttaagtatgggttgacatttgcaaactaactgatttttctagaagaatgatgccacataatttaaaaatattaatgcttttctaatctctagtgtattttcaatggctaacatagttaaaaccaaagtgaaatttttattatgtacataatcgaatgcaaattgtgtcaggctagtttaaaaaatatgaatgtcagtcctggcttggcaatttaataactatttggtttttgaccaagtcatttaacttaattaaacctcagtttcttctctgtaaacaagagaaggtcaagcaagatagttttaaaatttctttccaaatttatacgtctgacttttctaaaaaatctggtttacactaatacttaaaagaaattatcttaaaacaataaattataaatttattttttgctcttgctccctgtaaaatttgtccttgtcctgctagtcacatatagtccccactacaccagccaagacttgtcagactggttctgttgagatcatcagtgacttatttcctcacttcaattcagcccacaaagtcattgatagagctggattcacacacttggatgtagacctcgaccttcacaggactcttcattgctggttggcaatgatgtatcggtgagttagttccctttttctttctagaagtcttaaggtaacttttagtttaaaacagtatgagccacaccaaggaatgtgtagatctacagtttattatttttttaaatatagaaacatatttttgagattttacataaaattatgtcaagaaaaagatttctattctttctgtattagtgtttcctgtcctcttttgttgtatcccatgtgtttttctgtttacttttagaaggtttctacacaatgtaaaggtacatggtgtttgacagctgtcttttagttagtttggccatatgtttcaagaaagatataacatatttttagcttgggctttgtttgtcttattgagaaacacttttattttagaaggtgtacatgaaaaaaagtctgaaataatgcagaaaaaaatgtttatttctgtaagtagttaaaaatttaaaaactctagatgttttgaaagaatcagaaacaactgaagaaaataatatgactaaattattatagcctgatttaaaaaataaatccactgatatgcctggccatagtcaacttctccaaagataagtcatgatcattttgaggttttctttcaaagttagaaactaatcagtaacaaggttttggggtactagttttgtctttgaaaataattttatctcctgattaaaatttattttctctgattctcatattggcatatcattttttattagtttttactttgagaacagtttgaaaatgttaaactttgaatgaaatctgtggtcttcatttaacatggaaaaacaggttctgtcatcagttgaaagttctacatacttgttattagaagtttaatactcttctgtacatatccatgaagcaactaaaagctacggatactaaacattttgttgggcttatcaaggctccctgccttttgcaagtatttctttacaaccaatgatggttttgtatcctattctctttttctcattgactttactatagaaaacagtgcttcaagaaagcttccaataaacttaacatactaaatagattacaagccttatctatggtatatgtcagagatttggaatttggttataaatgtgtagaggcggtataatgtgggaatactggagtgaatttttctgagtgtagtctctaatttgaagcaaaagatgtgactatttttaaaaatcctgctgcagaatagatgcaaataatctctcatggaaaaaaccaaaaaccaaaaccaaccatctaacaaacaaaaacgtcttcctgatctgaagattgtatgaaagatgaagcacatctatgtttgagtgggtctagatgagataaaatgttaagagcatgtactagagcaaaaaaggattaagtttattattcacatttgctgtcgtaaatgtgccaacaggagtgttatcgaggaagagggataattgaaatcctaggatataagtagacaatttcttcttaaggtcattggttttaactcagaaagaatacaagaaacaggtggggaattttattaaatagcatgctccttccttttcagtcagatttcggatagccttctccctgactctacctgaataagaatcagttttttttgtttttttttagaatttaagggtaggaaaaaatttaaactgggtaagcattattcttcttgtactgccattttctccaaactcttattttggactattctttgagcatgaagagatcaacacatgaattttataaacacacaacagaaagttaaagaaaactctatcaggcataagtttatagagaacagatttgggaagagaagaatgtgtccattaaatatatttattggtcataggggtgtatactaactgtatttatcagcaaccactgagaagaagtgaaaataagcagactgaatttataggcatcgacatccacacatattgagatggctgaaggtgaaatgagtaatattcaaatgagacaaaatggacaactttaatttttacctaatagggtaagcactgtctctaaaagtgtggtccgtagacccctgcattacagtgcttattaaaaataggaatctccagctctcatcccagaaattctaatgaatctctggttgagacatggaaatcatatttaaaacatttacacaatgtaattcttatttaccctaaagtttgacaagcactaatggtgtaaagacatagaaaaagaaaaagaaatgtgtaagcctgaaagaaattaaaccataaatgaaataggccagttgttaaaagtagttctgttttatttaaattggtgtaattacatcttaatgggaggtgctctttcccagtcacctttcccttcaagggagaagagtactcatttatgcaacatggtgatgattaagaaagagaggataatttcagaaaggaggggaaactgaggggggagaacatagacattttttgcttagtttgtgtctgataaggaagatgactttatatggatcataaaaatctatttgtttacaggaaaaaccttggtataaaattaatgtagcagtgttaccctgtgacattagtcagtatggatactgaagagacactccttttaggcttaggcccagagttgctatatggttgtgttataagtatttagcatgtgctcacacttctccttcaactagaatcagccctgatccatataacaacttttagtgagttctcattgcatactaagtcctgtgtggaagaaaactctctgttgagcacctactatatattgtgtattttataaaatgcaatttcattaaattttggtaatgttttgataagtggttattgctttcattccttttaaaagatgaagcacctgtggctcagattgtctaggcggttagtaagtgtcgaatctagaatctaattctgatctttctgattttaaaatatacttttttccctgtaacatattgtctaccatgtgtaggaagctataagtagaatctttgagaagtttacagagaaaatagatggcaacagagaaatagaaaataaacgcacacatatccacacatggagaaaatgttggtgcatagatttaaaaaaccagaagatgtaaagactaatatgaaatcatgcacatttatgctgaggaaagaagtgtggaggtgtaattttactttcatttataagttttaaaaacattttaaaaaatgcattgcctgcccttatacaaccgactttgtatttaaactaaataaacagtgatctatcttttctgcactgtttcaaaggtgatcagagtatagcactttaactacatcatctctgttttctaaaaaggattacatttgctatattgtgaaaatcatgtttatcttagagcaatatttcatggaactaattcactggtctgcagtagctgtctgctaaatgaatctttgttgttctgtcattgttgtctgctttcctccaaaaatatgtcattgcttcaacttaaagagaaaataaatagaaacaatccagagaaacatgaaaaatagcagtgtcgtgtgtttccgtattagcactgagatttataagcatgcctgatggttttagtgcttgtgaaagaggtagattgaacagtcgtgaagcaggtcttctggaagggtaggaggtaaaatgggttctctggcttgttttatggctctatcagggttagagtttagagaaactgcacagagaagttcttcaagtgcgctcctttggatctgctctcattgaagataatagctaagaactgtgaagaatactttcacattttcaggttttaataggtttaaaatgactggactagagagaaggaaggttttaagaggttgagaaagaaaaatgggctgcagaaacactgagtcatgccagaacctgtaagcccaaccttcttctcccatgtacacacatggcctgtgtggtagggcaatttttagaattgcaattctaagatgatagaactaatcttagggggatccaaagtactatacaggcatatttaaattctattttgcaaccttttatctgaaaatgtcagatgatatctctgttttgaaactgcaaaagcagacacagagggatttagcactttgtttaaagttgaactgtgagtcagtgcaggacaaaataataattgctatctttagtttcacatgtactatctgccaactactgtcttaaaacatcatatgcatttaaactttatatcaacctatggttatattatcatactcattttacagatgagaaaaatgaggctcagacaggtaatttttttttgcccaggggtaataataaaaggcagaactgatggttaaccagggtctatctgacttcaaagcctatgctcttaatcacagtgctataccaccctcacaatgtctcctttgtctgcctaagtggttcttttactactttgatttaactgacttactgtcttaaaaggtgaaaaatttacattttcaagaaacattgttatggatgatctttaaagtagacctctaaggccagtggataggaagcattgctgtatgcattctctaaaggaagggaacaaaatgctcaaagatgagataatttgcatgtggccacaggaatgggtgagtcagtcaagacagagatgtagtctgtcctcccacttcacctgtatactgatgtcaatacagtcaaacagaagagttaaattaacaccggtggctacatgacccaagacatattattgttatttttattactattaccatttaagcttgtatgaaaatatgtggcccatttaaaattagttactttacattaaattttgtcaggtcacagttagtaaaatttagagagggtacatatcgtaacaataaaaatattatttgacgtaaatatgctacatatgtaatttcaacatatgttttctcatttggtactttacaacactgagaatcagataattttaatattaccatgactttacagctagggaaaccaaaaattaggaagactgagacttccaaatctctgctaagtgactggtagagctggaatctgagcacacctgttctcacatcagccctgtgctttctagtcctggcttctgccaggtcatgattctgggatcagaagtgcttctttggtgaagcacagataacttaccttggctttcaaaaaattactttatcttagtgtttcaactttcctaattcagaaaataccaaagataataaatgaacactttaaaaatatttcaaaccaatcttttaattatatagtacattcaagtcattattaggcatttggggatacattatttgattcaacaataaagctatatttggccttttaaaaacagggtaatgaattcttgtactaaactgtaggacaactggcagctgcctgactcaaatctctgaattggatgggtccgaagatgaacgctttttaaagttttctttactagttgaatccctttttgcactggaagcttaatgcagacccttgatgtttggagcagaattgctgtgggtggagtgggatagaggctagaagcttcctctaccttcctgtcttttattcccttaggcatacgtgaggcatctgagtggatttttcaacccaccttaaagctaatttttcattatgaaagaggaaataatgacaatggccaacttttgtggtgtatttactgtgtgcctggcatggtgccatctcccttgtgttactttatttaatcttcagaagaatcttctgagttaggtcttatcattatctccatttgtgggtggggaaatgtagatttagagaaggtgagtaactttcctagagccacctaactagtaacaggcagttaggactaatcccaagctgtttgatgcctaagcccaagtctttatccactaaacaagaaaatggaagtcatttgcttaaagtcatagagcttgttacaaagaggctcttgactagaaccttggtcttctgatatattaatattataattattaattgtatctcaaaattatgctgctagagaaaattaagttaaaatagtttaccatctttcacatatacagaatttgcaagagaattagtaaatacacgtcttcatgtcctcttttcccaaagatcattatgtgaaagtggcaatttcccttgattgcaacaatctgttttgcatattataatagtatcggatttagctacgagtgacaggaaacccagagtaacaggggattacataaaatggaattttattccgtttaatgtgaaacaattctggagataggcaggtaagagctaatagggaggttcacaaaataattaggaatctagtctcctactattgtgctgtcctaccagcttgattacgtgtcttccaaatcctggtctactgtggcaatccatgcttcaactagcacatatgtattctaactatgaaatgcacattaggattccagccaacaaaatagagactccattggaaagaaagtattcatatgctgactcttatggacaaggggcactatttgatttttctggtggctgtgtgcctaaccaaagatcaaggtttctgttattagaaaaaaaagaataaatatttgggataggcgtctaggagtttctagtatagctgtattaagtttgaatggtaagaggtatagcccattgtgatgaacataggctggtggatatatagttttgaagtgtaggcaagtgagctgagctgcagttatagatttggtagtcatcagtatatagatatgaattaaacgcatggacattggtaactaaaagtatttgttcttttgggtaaaataatgcatttcttataatttttatggtattaatttgcacagaaatcctactttattctaatatgaacctgagcttatttcactatgttattattaaatgccaatatattagaacgtaattgtcaaggtgagtatataataaaaaatttcataaattttatgtaccatccaaaaattaaaactgaattcttacatatatttcaggtcgataactggggcagaaaattctttaatcaggaaaactcacttttcattttggaagaattatttaaacatcgagagggtctatacatttttcaatttctcctcattgctgaattaattcagatagaattttgttacatgtagaaatttctagactgtctaaagaattcttggtgtatggtttagagtgctttctaaggaaacagcaagccagaggacacaacaaggtgtcagcatgtggcccaactgtcacattcaggcacattttaatcagggtctagagattttaaaaagttggtgtatagtagttatacatattttgggggtatctgtgatattttgatgcttgtatgcaatgtgtaatgatcaaatcaaggtaactgggatgtctatgaccatcttgtgttggaaatattacagttctcttctagctattttgaaatgcaaaacaagatattgttaactaaaatttccctactgtactgaatggtagaacttattccttctatctatacatttgtaccccttaaccaacttctcaatacaagtagtaaagtatgattttcaaagtctggctttctcaggtatggtatttagattgtttcaaataacttgtagtctcttagtttgactgcaaattatttcaaattatctgacattgtagtcaacagaaaaatgaggcatttgaaaaattgcctgaagtctgattgtttaacaaatgctgaattttaattaggatatgtaactttttgtgttatgtgaggcatggaacattagcttggatgaaaattgaagaccatttagatcaatttaaatttccgctgattttttaacatgtgaagaaaaggagagctctcaatatcatacaagttggggctcaggggatgctggaactcgtttgatgtggagtatgctctcagatttctcatctgtttgaactaacactaagacataggttactggttttacagtttagatctacttccattctatcatgcaaactttcttggagtcatctagacaatgtcaagaagaagatttggtaggaagacagctaaaattttaaaaagtttctgaaagtctcaagctatatattagcagccacaagagtgtctctagctcaggtttctcaatcatttttcttctgatacacttgcagtgatatcagcacactgcttgttaattcttatttttcttccacattttgaagtgtgtaaaattccctatgattggctgcaatggcatcgctcgttaactttgctgtgggatattgttgtgtataaagttgctcaggtaatgccagtttattatcttgaactaaaaagagtttgaggaaaagaaagcaaatatattagtagaattcaaacttcagtagcttagtttaagtctataaacccataactaattacttaataatatctttaatttttttgcaacccacctatctgtatgtagttgcaaatttctagagatcaggccaagtgtcaacttaaatatcagtttgtagtcacctgtgctgtaccatatttagttgggaacttaataaaaccttgatgataatcacagtggaggtcagagacattccttactgttgagttgccactaatatttatgtagtacacctatctaacaaagtctattgatatcatatgcaatcttcacaacctccttttaaaggtaagggaaagatactgtcacgtaagttttatggttggctaaacagaaatagttaaactctgggttttgtaacttctctatgagaactagccgtaattattatggtagggaatgcaaacattgtgattcagcccaagcgcctggctgatgctatcagatacttatagatgtgttttatcttccagtggataggacagaaatatgttatttgtaattttatgtggagtaatttgcttgtatttcttctttttttaaaaaaacagcaatgaaaatatataatccatgcacgtatatatgatattctgttttatttctactgtggatatttttatagtcctgttctagaaagtgtgagaaggattaattatgtcaccaatgcttgctggtttgggcttttcacaaagtaaaacacatctcaaatacttttgttgataggataagcaggcacaatcctatgagctaagctacggtcaaatacatatcatatgccaaaacaaatatatagaccaatggaacagaacagaggcctcagaaataatgccacacatctgcaaccatctgatctttgacaaacctgacaaaaacaagcaatgaggaaaggattccctatttaatcaatggtgttgagaaaattggctagtcatatgcagaaaactgaaagtggacctcttccttacaccttaaacaaaaattaactcaagatggattaaacttaaatgtaagacctaaaaccataaaaactctagaagaaaacctaggcaataccattcaggacataggcatgggcaaagacttcatgactaaaacaccaaaagcaatggcaacagaagccaaaattgacaaatgggatctaattaaactaaagagcctctgcacaacaaaagaaactatcatcagagtgaacaggcaacctagagaatgggagaaaatttttgcaatctatttatctgacaaagggctaatatgcagaatctacaaagaacttaaatttacaagaagaaaacaaccccataaaaaagtaggcaaaggatatgaacagacacttctcaaaagaagacatttatgcagccaacaaacatatgaaaaaaagctcatcatcactgttcatcagagaaatgcaaatcaaaaccacaatgagtaccatctcatgccagttagaatggcgatcattaaaaagtcaggaaacaacagatgttggagaggatgtggagaaatagggacatttttacactgttggtgggagtgtaaattagttcaaccattgtggaagacagtgtggtgattcctcaaggatctagaaccagaaatactatttgacccagacatcccattactgggtatataccaaaaggattataaatcatgctactataaagacacatgcacacgtatgtttattgcggcactgttcacaatagcaaagacttggaaccaacccaaatgcccatcaatgatgtctgttatacgtatctcatttcttcttcaatgatagactggataaagaaaacatggcacatatacaccatggaatactatgcagccataaaagaggatgagttcatgttctttgcagggacacggatgaagccggaaacatcattctcagcaaactaacacaggaacagaaaaccaaatactgcatgttttcactcataagtgggagttaaacaatgagaatacatggacacagggagcagaacatcatacactggggcctatcagtgggtggggggctaggggagggatagtattaggagaaatacctaatgtagatgatgggttgatgggtgcagcaaaccaccatggcacgtgtatacctatgtaacacacctgcacattctgcccatgtaccccaaaacttaaagtataatttttctttttttaaaagaccaactattgattggtggtattgctgtgaagaggcttcttctggtaaatttttctttgaaacactgagccttgacttgtcattttccagtgcttgccattagctttatttgcactagtacattttccccttgtctttttgctgttgctgctgcttttcttttttagcactattctaaaaattacacattaataagcaataataataatgcagcctaagcatattgcttgttttctggcaatttggggctaaaaaaacaaagcatactttaactgttatattcacttgacttgtcactaattatacatgtctccagattgaaaagaaaatcatataaagaaagaaatttgatattactaaagctgttagaattcaatcagtctatctgaaggtgattttacacgaataggtgcacataagttttgatagatgaaaatattgactggacaagtgtttatgtatgttcaggaggaggttaattatacaaacgtctgttgatatgtaaaataaatttattccttcactttactactttctttgagcatacttttttcacatctaatttggaggaattcagtattgaatcacttactgagaaaataaaaaagtaactaagaaataggatcaattatatctcaaaaaagctaaaaaatagggtgaatcagtttgaaaaacaatgctatacagactgggaaaagaacaaataatgtttcaagtgacaaacatcttagtaatgtggtcattaccactattactaataattaaaataatgatgatgataattatcatcctcgttatttgtacaatgatttttccacttgggagctcaaagtaccaaaccgccttctcatttttatctctacctagctcattaggttaggaggggtctggacttattatccttgtttttcatatggagaaattaagacagataattgaatctctgcgtacaagactatataataaatgagttggtggcagggctcagaaatataatctcttaattgtttattcaaagtatttttgactggattctctttttcctttgtcccatattatcccttttgtctacttctagccactcaggagagcatgtcactaaaatagttgtgagtaatgtggaaaggtgggggtcagaagaagaatcacagtggtaccttggacactgcagtgatgtaaattccatgaaaatacatatataatcttccttagtttttttttcatattttaagaatgtcctatgtctctcgctctcttttttttaattcaaacgccataatgttgttcttaaaaaatccaccataaaacaaacaaatccataaattaaaattaaaatttctcacttatttgttattcggcttcttactaataaacattggttgtgtcttctatatattttgttatgcacacacatatatagtttcattatttatgaaaaccgaaacatgaaatgcatattattctataactttttaaaattgaaacttatcattaacctttttaatgttaatacatgaaacctacttcatcaatagaatggctgcattgcttacatttttgtcttgattaaaacttactgtagaacaaatagaacgtgtctaatatttcacaattctatataacaatcatatacttttgataatttcatgttttctacaagcacacattcattttcttcatctgacatgttttgatattagttgagaaacccttctctccctgtattccccccaaagttttgcttacgtgtgttatacccatctcctttcttctgtaacagattaatagcaagcattcagggatgaaggaagaagagtcagttttgggggtttcttaggctcagttgcacataaaacataatctcattgtggagaagactttttatattgcagtaattgacattctaggaacaggtgtttggaattctactcaagggaaaactggagatgggaaaggttgaggagagtaagataaaagcttccctggttacggccccgtggaaaaatcacaggaacaaggcaggagaacaagcagagcccctggagccttccactacatctcagtccctttcccagggacaggattatacagcgatgataacaccattgacttctatgccaatgctctttattttgtgtccagccagagccaggatctaatgatggtgtgacaggggccaacatgataatattatcacttcctgatcctatatcatcaggaaacagagcgttcttgttttctgtaaacaaaaggcatttattgtgaaatgctttgctgtttacacgttcatgatctaattttaggtcccaaagtgctttagacggaatggttatcccgccccttactgatatatggggaaattgagctcagagtttaaatgatttttccgtcgctgatctgttaatgaaagggctgcacttagaattctccttattctgattcaacacccagtactcctccaggagaataccatgttttcctcaagtcctcatgtagcagacagttagcactctagaaaaaagaaaaaagcatagcacacactggcgtaaatacctcaagaaatctaaaataagagtatcatattcaaactccttagtcatctctgacttattatttcacatttctggctttagagtttgcttaccaaatattataacccaatgggacagcaactttaccaatcaaacaaaaatcatgtggatcaatgtttttcagtaacatgtatttttgaaggcagaacaaatagaagttgagggaatctcatgcaaaaagaatttcctgtagctttttttttttttttaagacggagtctcgctctatcgcccaggctggagtgcagtggcccgatcttagctcactccaagctccgcctcccaggttcacgccattctcctgcctcagcctccagagtagctgggactacaggcgcctgccaccatgcccggctaatttttttgtatttttagtagagacggggtttcaccatgttagccaggatggtcttgatctcccgacctcatgatccgcccgcctcggcctcccaaagtgctgggattataggcgtgagccaccgtgcccggccttctgtagcatcattaaagcttaaaggtaaatattagctcaaaacctcaggttctttaggaaggggcctctggttgtttcttctatgtatcctcaaagtttggtttggaaatagatcagaaaattagaagaatagaattagcaactccatgtgaaacctggtatgcttcaagctgtaacacacttcaaaggctatttaagattctagagtgctagagaaaaggcttaaaatatttttgtagcccctgcagtgtctaactctatatcaagtacatggctggctcaacaagtgatagctaacatttaatattgcacttttctacatgtcaggcattgttacaggcactttatatgtagtacttcatttaatcctcacaataatcatatgaaataggtactatcattatcatcttccttttatggatgaggaaacccaagcacaaaagtcaaactacttgcctagcaacaggagtcagagtcaggactggcctcagcagcctggaaccagggtgtgctctaaacccagacagtacacgaccctccaactgaatgtcctttattcccccaaaatatctgttttgtctaatgagtggatgtgttgcatgctctgaaataatctatctatttattttcttccttaggccagatgtggtgagggctaggaaaagagtttgttgggaaccctgggttatcggcctcgtcatcttcatatccctgattgtcctggcagtgtgcattggactcactgttcattatgtgagatatagtaagtataagctgccttggcatcatgtgatttaccccaaatatttcctcataccttgctgttttgatttgcctcaggcttattcatttatcactacgattcatttgcatagcctgtacaaagggatctttacctgctttctctcttatttagtcctcataagtcaaggaggattcttttttctatctttgatgtagtgatgctttctgctgggaacagcatgcttatttgcatcttccttaataagcaataagtgagtattaatcaaaggaaaactacaggatagctagaaccaatgtcttgagttgtttgaggtcacagggcaagcatcttgatttaaaataattctgaccgggtgcagtggctcacgcctgtaatctcagcactttgggaggctgaggcgggtggatcacttgaggtcaggagtttgagaccaggctggccaacatggtgaaaccccgtgtctactaaaaaaaaaaaaaaaaaaaatagccaggtgtgatggtgtacacctgtagtcccagttcctggggaggctgaggcaggagaatcacttgaacccaggaggcggaggtttcagtgagccgagatcacaccgctgcactccagtctgggcaagagagagagactcggtctcaaaaagaaaaaaaaaaaatccaactcgttgaagtcctgacatcccaataaatcaatgacacaatctggagtcataaagaagtaggctctattctgtaccagtaagttacaaaaatagtcatagtgatgtattgttgagtaagtgcctatttctgttattaaaatctcatcttaggatatattgtaagtgattaaagaggatagggtatgccaagaaagctaattataaagatgttcaccctgcggttatcaggtacctcattgctagatgaactgttagttgctatgttattagaaaggtctccagggtacttcagaactgttattctgggatgtaacagcccttctgaagtttcctcctactctgcctagggttttaattacttgactcaaccatgacctgttagtttaatatcttcctctgttactagattatacttggatgttcaaggcaccgtaaccatagaagctaataacttgattctaatttaattgggaccttgttgaagtttctttccagtaacgagaaagagtactctgtaacctggttatcttcctctactatccacgcaagtataatctcaatttacaaagcaaggtggatcatttctggatagtttaaaaaaatatttaaaacaaagatttttttggtagaatttgcatacaggcaagtctttaaatttggagtatctgcatattaataacagatttttctgtagcacactttttttttgctttttgagacggagtcttggtctgttcccaggctggagtgcagtggctcgatctcggctcactgcaacccctgcctcctgggttcaagtgatttttgtgcctcagcctcctgagtagctgagattacaggcatgcgccaccacacccggctaattttttctatttttagcagagacagggtttcaccatgttcgtcaggctggtctcgaacttctgacctcaaaagatctgccttccttggcctcccaaagtgttgggattacaggcataagccactgtgctgggactgaagcatactttaaataaaaatgaattgctggaataactttatagttctacagttctgctgagaatattgagtcctactttgttgtaagcatcattatttgtccccatggatgtctaggactgttttacacacttttgtgtgtctagaatttatcagaatcttggcacatgttatgtgctttataaatatttattaaatactgaatgataatatcaaatgaatcatgcctacaatattttcttgggccatacttcggcttgtctgacttcacaaggaattcctagtaacactaggggctaatcacctcagtgagagaaaatgtccctttctacttctcatttgcctcttcccaagccaagttttataagattcataaatcttagtcatatgtatacagtgaaaacttggcaagaattttttcagtaacctgttcctgaatcctgttgtttggatgatcaactgagtaatactgaacacacagcttctactgcccacacagtacacctgaataaacagtgattgttgtgatgtgtgttactgccttctatttgtgacctgctttctgttttgggatgtaaactaaccgagtggctttggcagacaaatatttagaagctgacatgccaaaataaccaaatcaaaccaaaccaaaaaaatctgtcacagaaatagacagatacagacaaaggtaatcagatttggaaaaatatcattttggttctcatttcataaagcccaggacaatgtagaattctgtgtatggttcgtgtctggggcctttgggggtgcatttctgcccctgtgtaatttggatgtcagaagatgaatctgttataagcaacatcactgcagattatagaatcacaaaactgctagaaatttaccaacaaactcatgtttatccttatttttaacttttctgttaatattcccaacatattttagtaactactcataccatatatttatggcagctggtaatatgttttaacagtggcatgcttaagtctacagggtaaagtaaaatactgagcacagataataaattgttaacttggttaaaccatatgaaattgccaatatttgactatttttgacctgtactaatggtgattttaaatcattcaatctaataagccaaaaaactacatttaagggtgtagaagggtctgttagcattctgtctagaatcttgctatttaatatgtgattagctaccagaagcatcaacatcacttgctagcttgttagaaatgcaaaatcttgagtctaactttagacctcatgtaccagaatgtgcattttaacaggctccctaggcagttcactttcacattaaaatttgaagcagaattctagaagaatggatacaactccacagagagttatagttaactatgaggcagatgttaaaaaatacaaatgtagtagaacagtagtttacagagatagttatgagttatttcccagtatttcaataaatttaaaatcttacttgaagttatgtatatttccaggtacctgcctgaatttcatgtcaccctggccattcagagaaagggaggtgaggaaggatggaggaagagtaaaacctcccaagtccttcacttaggtctcttgtactctggtgactcaactttcagtgtctcctgcctgccattcatctcttttattcatcaccaaccgcacccaagcccttgtcagagtctgatggctgcttccctctctgtcccatcaaatcctctggatggccagggtgttttatttgaaatacaccagtagttttttgcataacttttatacaacaaaagatttgtcctctagctttaataagtggctttttttcctactctaagaagcagcatgtgaagtaagtgggtactttgggagttagtcttggctatgtcctgctggacttgggcaagttatttacatttccaagactgtaatctattaaatgtggataacattgccttttcatggagttattgtaaattaaatgagatatgtgaatgtactagggacactggtgtccagtgttagtttccttttcttctgtggtttaagtgaagagggaaagaatagggaggaagagaaaggaggagagagactgtgactggatgagccacagtctgctttcctatagtaactatatacaactgtcttgatcaccagtgtatttctaatggttgacacagtgtctcttcctgaaaagtggttggcattaatatttgttgaatgaatacattaattttctgagggctgtctgcttgctttatgcactggagggtagaggaaaagttatatcacattaacttttcagcaggtcaaaaatgtgggttgcttaaattgaatgcagaatgtagagacagtggctaaggagcagacaagccaacccctgtggttggtgggaaaaacatacatgcagtgacaaaggacccaggtgaaactaaatagtgtccctggaaggttatgccaggtggcaactttagctccctaaacttccatttactgaatcccttgcattttaattcctaacctcatcttccttttcagccaaaataaattttctcaaactagagttcttgcggccagaattgatgtatagttgatggaagggaaaagaaaatctatgtttggaatataaaaatgcagtgacccttgggaggcttctgaatccatccctgtttgtatgctcagatggcatgacttgctgtctcttgtggcttacttaggaatgagtaacacatgaataatcagcccactgttccaatgagctacttgtacagtactccaggaacaccaggcatttcttacagcttttattctctaaatcacatgatgataaatgttgttgttttttatcctgagataactatgaggcctggggcaggatgatgatgatgacctgtgctaagagcattccttcctgtttcagtcttccagcaaccaccaagcggggatataatgatgctttacacacatctgataaaaattatgatagtgttttgcttctttccttgtagatcaaaagaagacctacaattactatagcacattgtcatttacaactgacaaactatatgctgagtttggcagagaggcttctaacaattttacagaaatgagccagagacttgaatcaatggtaagcaacttgtcatctacttctagtgcatttgctttcactttttaccatatttttagcatcctagcttctaaaagatccattcaactaacggatccctgtgtatttgcaaaatgaaaagaggccctaacccaaggaatataaaacaaaatggacaatacatcacttagcacaatatgactcacagggttgaaccaaagaaactttagccattcggtcaggtccttcttactcacctttccttagctagtgatatactcttgatcagtagagtccagagattctggaaatgtgagtgtggcttaaaatatatttgttgtatcctagacttcctaaaaaagagaccccgagcagaagattgccaagattgaaactatttaggcacatacctaaatagtctgttaggttttaaaaatatctaaccttcaaccagcttttggtatataaatctgtagtaaatccacagatatgcaactctacccagtttttaaaaatatttaaccttcaactagcttttggtatgtaaatccacagataagcaactctacccttaacgcatcaacattcatcttgagggatcaattaaatacttaagaaactggaaaaattagcagcatgggccaaaagaacaagggcctaagtggtaacttcttgtcattatcagattaattaaagaataatttaacttttcctggaaacctgtgaggtaattcatgatataatgtgatggaaagaacactgaactgggagctgggaggcacatgtatctccaatggtatctactaggtaatgatacatcacttggaatattagtttatcattctgcacaaagttctgtaaattgaaaattaaggtattaggttagataatttccaaattgtcttccagttccaataacctgaataagaatggaagtgagaccctggaaaccgcccagtagacagaagcctggggatttggccaccttgctgagacagtggttgaatcctggttacatttgcacttgcaaacaccaaatcagggaaatatttgaccaggctcttctctaaggctaaatacatatgcaaaatgaaggaaatgaaattgaattaaaaaggtcaagaagagatgccactatttcccttgttctttgtgccattcattcaaataaattttatttaagtaaataaaatccagacagatttaaatctaaaggaatatacataaggctctttaatgccttcaaaattaataatagttttgaagttacttgacaaaaattaacccttaaataaaaattttcttgtgaatactgccatcctattcagaggacttctgctattcagctttgtctcataatcgcaagaagtgtccttagtaaaaaaattcggaattaataaaatgtaagaaagaattaaaaggctcattgcttctgttaatcaccagcatgtagtaagtgtttactaaatatccacatactggaaacaagacacctttgagtgtttccttacataaactcctaattaaaaaattaagttgcctagaattcttatttagaataataactaacgtctctacaaaaatagactctttcactttagtagagtaaaactcataggtgtgttaggctaagtatcccagttcacctgggcctttctaagagcacttggagtgctgaacttcgtgtacattatgccaggaaaactgacaactttgtcactaggtttgggaagcatttgacatggtcatgcactcatttctataatccaagtattatgtggcagaattatttcatttcctttgtctatgggcagtaaaagtccttacttcagagtaaaatttctcactcttaattttgaagaaacagcatgttcattttctttggtctctttctgagcattagtacagcagatatcacttctggccccactgcggttccctactcctatcattcctaagacagcgttcagttgaaatcactgagaaaaccacaatagattcctcaagcttcctcagttccactcactgtgaaatgtcaatgttttttgctctgttttgttttttaattttctaaaaagctttgaattaatttgtggaatttcagaaagttgttcttgctgatatattttgaatatttttacaaacaggtgaaaaatgcattttataaatctccattaagggaagaatttgtcaagtctcaggttatcaagttcaggtatgtaaatctgaattgctgacttctgaatttaaagttgaagctgttaatctgctcagcaataaatatgttttcaagtgttaaagatataattcaatccaacaaacatttgacacttgtcctgtgtaagtcatgggttacaaagtcccttattcattccttaaatcccaaagtaagcatttgcaagatggttgctggggacagaggtataattggtgcctatgttataaaattgttttctgggaaacttaccaagtacagatagtactaaatacagatagacctaacacacatccttggtttaatggcaagtagtgccccatgtaagacaatatagtagatcaggtttgtctttagctcttcttcctcctattaatcaatcttctttatcttcttctattccatccctccattctcaaaatatgtagctgagaaaatctcatctgtcaactaactattgataaatgggtttagtacataatgttaaggaaaatattataagaattttcaataagatattgacataatacaaattatttgtattaaaaaacagaataagaattatttccaatattattccaatgacaaaactttaaaagtttcctgccattctattacttagctgatatctctaaggcattactttgatcactgtcttctaaaaattctgtactctctggtgtttgagatactgccctttcttggatctgcaactacttctcttatctttaagtttcactttctcaaagggacctcattcacccacatggtctcatatgctattgaaatacaagtttctatctctagtctgaactatttttctgatttctataactatatacacatccccatgtggaagttccacagaaaattccctaactcaggaagaatccaatcacataaatgagaaacctggaagtcatcaaacactccttcctttcctggtcccctcatactttatgaataactaagttccactaattctattttcccaataactttccaatttgctcacctctttattccagtaatcttgctactgctactcattattctgtcttctgttactgcaatagtgagaagagcaagtttattggaaagatgaagtcaattttggagatgttgaatttacattctaagggaccatatgaacctgaaaaatgagggtgactcagtagagggaaatggaactgagcagaagatagaaatttgctcatgatcaactcaaaaatttggaagcatgggtgtaaatttctcagaaaaagaataataaaagggaatgaaaaggatgacaaagaaagcttgaagaccaatatttaaggtgatggaaggaatataggaaacttagatatagggaaagagcaggaaaatagaaaaatcatgacagaatcaccactgatgcaaaagataagaagtttcaaagagagtgtggtcggcattgacaaatattcctgactgagtaatataaatattgaaaagaatccactggctttgtcaactaggatacttgggttgttacttattttcgtgtcctgaaaatagtgttacaattaacatgtttataggtatgtccttgcacaaatgtatgagtgcatttgaatgtttaatttctagaagtggaaatgctgtgccagagaagacagatattcaaacttataatagataacactgccatccaaaaataagactctaatttgtattcccacttccagtttatgagagtagtggttgatgcaatatatagtgaagagttagattcagaagtgactatgaaaaggagtgggtaaagtagctggcaggatgattccaaggtagtaattcatacaaatagtattaagactaattaatgctctgtgttgaaaatacagtcacatgaagtcagtacaatttggtaaagcggtcttatatctttaggattaggagttgtttaggatagcctgaagattgtttaggggaggtaagtagacttgagtcacaagaataaaacctgaaattcaaaaccacagttgatttcatatttaagacacactgtatttgataattttgaatggtttttgacaaggtgtctttttatattaatagccatatacttaactagaccttttgatggtaagggagaccatgaacagactaactcactatatgagaggctgaatttgtggttcttcacatagtaaacagtagcaatatagaaggaaacatttatggatgtattttatgtgtgcatttcatgtaagtgataaagaaaaaagcagattgtgatattacccttctttcttttcttttctcttttcttttctttctctctctctccctctctctccttcctcccctccattcccttctcttcacttcctttttcctttcccttctccttccttccttttctcttttctttctttcctccctccctcctttcttcacttcctccttccctccctccctccctcccttcctgcctttctttcttcttttcttttctttctttcattttcttcttttttggcccacagtcaacagaagcatggagtgttggctcatatgctgttgatttgtagatttcactctactgaggatcctgaaactgtagataaaattgttcaacttgttttacatgaaaagctgcaagatgctgtaggaccccctaaagtagatcctcagtcagttaaaattaaaagtaagttaatttctcttatttttctttcatagaacagcttcatgttaggtttgatcttggcacttattaaaaaattttttttgatgtcctttaattctggggtcttgccaccaacagtatatttctttggaactaaatttgtcctaatgaagtattttaatttttaagactaccctaaacttaggcctcccatgcaagctttttattaactccttagcagttttctttatattacactttatagtttggctatagaatccaattataagtgaagaaaatggctttgtattttcttctttttcttgttgctttcattgtatgttctgagggtgtggtatatggaaaggttcatgccatttacacatttgttttcaaatgtcattaatataccttgctatactttcttcccttaaacttttcaccagtgaaacatttataataaacttatttttggtatatttacaactataaatgaaaaatttaggtagatttttgttgttcttgttgttattgtttgtagggccacatgggacaaaacaagtgatgataggtcctcacatttagaaaataagaaatatgagatcctcagtggaaattaagatctggctaagggctggttcatatgttacagaacaatgaaggtctatagaaatactatctgggcacaagtataatgttacattttctagaagttacattaaaaataaaaataaacatgtaaaattaattttcaataatttgtatattcaacccaatatgtccaaagtattatcatttaaacaaatagtcaatgtaaaaattattcatcaaatatttcacttttttttgtagtaaggctctggaatctagcgtacattttatactgatagtacatttcaatttagactagccacactgcaaaagctcattggccacaggtggctagtggatacagtagtggatatggcagcactggaaactacagagtaggggacaagtagagagaatgaatacaaactgctaatataatatctgatagatctaagtagatgcctaaattgatggccagccaacccacttgcttaggaaggaggcttcagtagtcagggacagatacataatttatgcgccttagcacaaaatgaaaatgctagacctgttttcaaaaagcaagaaaaaagtgctgttaaaagtacaaagatataacacttttctttcttccctggtctcgctctcgactttccatggtgttttcatttgctgattattgtcattctaagagaaaaaaattaaatttgtagattactaatatgagtttaattgtttatatcatgcaatgtcgatataaatgcatatataagtacatttaacttgtatttcaaatcatggaaattatgcaactatatttcgtagcttatacatacatgtttttcatttttgcctcaatggaaatagtacaaaaggctaatgactctttttattttcctggttaatatgagaaaattctaccaacactctctaccttcagcttattgaggggtgaggaaggactagaaggaaaaggagatctggatttccctatctttctctttctacattgtagttttcagcaaaagttgttggctaatacacagaagtaacagaagcaagaaaggatatggcaggatctgttgttcatttgtgtttattagaatgctattgtcttttctatgggttctaagcaagttttggttcaaacagaaaacatggcctccaaggcatgtcagtccacctctgcttacttaatggaagggatagcacacttaccttgtacttgctttgagtcttgctgaacccctgtggattgtgggtccactagaattctgatttcatagggaattgtgaatgatatatgcaaatggagtggaaagaaactatggacacacttattgcacatatcttgtctgccaacactataatccattatcctattgaacttcattttcaaaacacaagttacaagataaaattattaagaatgtcaagtgagcaatagcagagcattgtaccaagcacaaggccattgtgagtgtgagacccagtgcagatgtataagtcacacatgaagccagccttgtcagtgctatcaatactcagagcttgacattttcctaggaagagcttgagatagagaacaggttatttgaaacaaagagatcagaggtggtccttttaatattaactgagactaaattgtaaattcttccttatttttgccattttccccacaagtagccagaataaataaagtcagaaagaaggccttctagaatatagatttccacttcattcatactattaaatactaaagaaaaaaattaacactaatatttttgcatttagagcatccatccttccatgtacaaagaatagttttggtcattagaactctgctgagtcagaaagtttgagcttagagttttatgtatctattagctgggttagtgtttgcatagggtttgagactgactagtgagaagtcagcaagctaagaagtcattggctggagctaaatgacaatttgagggcagactgtcttttgaaatttgacttcaaaaagggtaacattgtttttaactgtgagtgagtacaaatttatggagatgctactcaggtgtgttatacaaatgggactaggcttatgagctcaatgatacaatctgaaataatggttaataaaggtattgttacatttggggaattaatactatggtttagagtagtatttcccatggaggggctgtggactctctgcatcttatttactggtataaaatccaaattcttgggcgtcattacaagctactgaattagagttactgggaaggtgaacaggagtttcattataaatatgcttcctatgtgactcttacccacattaaagtttaacacaccgttcacattctctgcaatgtgatgatcatcctatgtctatgacaagctatgttgccttctttataatctagagatactgttttataataaaattaagcagccttttagtatttgaaatactcggaggcatagtgtaactctgatgtgctgaccctatttgccatttctgtgtgtttcagaaatcaacaagacagaaacagacagctatctaaaccattgtaagtttaatatatttattgaaatagcattacctgaaggtaaaaagctaacactataggtcatttaggtttactttgtgttgatatcatagggacagaacacataaagtttgattaatttgtgtacagttcatggtactttatcatatcttggagatacattttattagtaaaggatagcaaaattgagataactttggagtggatgtatgggtgcctgtggcagatgtgtagtggaattgagttgtacagctgttaaagaagaggcaagaaatgtttacttatcaatgttctgtttgtaggtatctataagataaaacaaatctatacattgtgtttttcagctagaggcagaaactcattgtcactatatcctagataaaatcttcttgatgttattaatcctacggattaatacgaaagtgcaggaaattatcgggtcgtggaagagtcacagaaagtgcaggaaattatggggtatattttaataaaattactgaagacacatagataatatcttcacctatattataaaagtgctgagtctaggcctagcacttttcttctcctatagccaagtatgccaccatgatttacagtatacattcaatagttatggggttgttgcacattacatttctcttaaaaggtggaaaaatatgtgctactcaccagctcatatagttggttaatttctaaaatcaactaaacacaaaaccaaaagataatctcattacctaaatagcatatattctcaccaccaatatttattgggaacctaccatgtgctagcactgtgttagacaacaggcattccaaatggataagatataatatctctacctgaagcaccttatactttaatgggactaggtgcatgagactaattcatgaacacatcattcttaaacaacacttctcaaccaagggaaatattgttggccaagctatcatgccccactgtggcatttttgtcatgaatatagggggagggctactggcatctacagtggatctacagtatataggccaagatcttatgatgcacagggcagccccctacaacaaagaattaaatggttcaatatgttagtggtgctaaggttgaggaaccctgtcataaacaatgtcagtatgtatacatacacataagcacacatacagagtgtgtttgttatacacataagcacacacacagagtgtatttgttactattattattttggaagcaccaagaaagtaataactaatccagattggagacaggggagttagagaaagcatcctagagaggtaacaactgatttagattttacaaaatgaacaggagttagctaaataaaacattacagtttacagaaaggtaagagcatgagaaaacatttgatacttttggagcacaaagtagaagaaatatgggacatagtaacacaatttgatgtgcaaaacaactgctaattaatgcacccaccaatgcaccccccctctctcttttgcaggctgcggaacacgaagaagtaaaactctaggtcagagtctcaggatcgttggtgggacagaagtagaagagggtgaatggccctggcaggctagcctgcagtgggatgggagtcatcgctgtggagcaaccttaattaatgccacatggcttgtgagtgctgctcactgttttacaacgtaagtcttgaaccttgagaatgattgggagtgaacaaagtgcactgggttttggcaagaaaatacctcatgaattttgggagatatgagtttagcataaattaaaaataatgtgtatatcacaaaagactggatcatttgtaaacattagtaagaggttttaaagtctggaaatggaaatggagtcaaagtatatgtaaataaataatcttttgataaacacacaatagtttctcaaagaaagcaggaattttaaagtcatttttggatttgaatttgctgtcaaacaggagtgctctatctctgctgagtaccttaatcagagatggagtctggataggttgtaggtttgatcctaagggggaaatttcacatggtaagaaaaagaattaaatacgaagaattatgtaatgaagatatgaagaatttggaagtagcaagttgtataaatgaatagattgactaattatattgcaagaaatggaggacccttcaatctattgtcaaaatgtctatagtatataaaataataatactttgttaaattattgtgtggactttttggttttcagagaaatgtgtatatttctgggtggggtacatgagacacatagaatatattaatttctcttattctgtacagggtactttccataggtcccttggagtcattaatatacagaaaaatcaaaaagccttagcatttggagtggatgacttggcatatggagtggcatgtatattataggaaatggtggctttttcacctggtcagaaccctgagccttattatcaaattggaaagagttctatacatcaaaactataaaaagaaaaaaaaatctacacctgtagactaaattatttaatataaattattcgactggtagcatggtaaaaagaaatttattcttcatttttttctccccagatataagaaccctgccagatggactgcttcctttggagtaacaataaaaccttcgaaaatgaaacggggtctccggagaataattgtccatgaaaaatacaaacacccatcacatgactatgatatttctcttgcagagctttctagccctgttccctacacaaatgcagtacatagagtttgtctccctgatgcatcctatgagtttcaaccaggtgatgtgatgtttgtgacaggatttggagcactgaaaaatgatggtgagcgtcggaagaggaactcaagtaaaagttaaattggtattttatggcatttaagcaatgaaatgccattatgccaaaatatgttagttgtgtggtcatatgacctggaccaagtcaggccctaaaagtgaagtaaataacttggaaggcacaaaaattccttcctgcctaagttaatatcgagtaaattgctactactatatactacagtcatagtactgctaagatgtctgaaaaagcaaatatgtctcctagccatgaactttctttagagaattaaccagtttagagattagcaatcaataatatacccaattctgaagattggagaatcataaagccaccattctcccctactgaaatttccttgtaatgttaacaatggagtggacattatttagataacttgtggttctttcctaggcacccaactttttgctcaaagtagttaggaacaaattatcttcccaaatattattgttctaaacatatgtagtctaagattctgtatcactatctttttttttttttttttttttgagacagagtctccttgttgagacagagtctccaggctgaagtgcaatggtgcgatcttggctcactgcaacctctacctcacaggttcaagcgattctcctgcctcagcctccccagtgattgggactacaggtgcccgcctaatttttccatttttagtagagacagggtttcaccatgttggccaggctggtctcaaactcttgacctcaggtgatctgcccttctcggcctccgaaagtgctgggattacaggtgtaagccaccgcacccggtatcccccgcttttttttttttttttttttttttaagatggggcttctttctgtcccccaggctggagttcagtggcccgatcttggctcactgcaacctctgcctcccgggttcaagagatttacctgcatcagcctcctgaatagctgggattacaggtgcatgccaccacccccggctaatttttgtatttttagtagagacaggatttcaccatgttggccaagctggtcttgaactcctggcctcaagcgatcctccaatctcggcctctcaaagtgctgggattactggcgttagtcaccgtgcctggcctgtatcaccatcttattcctaatcatgaaacattttcttcaagtttataaaatatatgtatgtctacaaatacaaagacttttttttcttttaggttacagtcaaaatcatcttcgacaagcacaggtgactctcatagacgctacaacttgcaatgaacctcaagcttacaatgacgccataactcctagaatgttatgtgctggctccttagaaggaaaaacagatgcatgccaggtaaacagttttgcccattagtatgttgtgtaattttttgtttacttttctttgaaataattatatatctacaggaagttgcaaagatagtacagaggagtcacaacatctcacccagttttctccaatgattacatctcacataactatagttcaatataagatctgggaaattgacagtcgtacaaagtatgtgtctaattctatggcattttgtcacatctgtagatttgtgtaaccaccactacagttaagatgaagaactattctatcaccacaaagacctacctttttccctcctcctactatccctaacatctggcaatcactaatttattctccatctctataatttttcaattttcagaatgttatataaatagagtaacagtagctttttaaacagaatttaattttggatcatctattggtatttttggcttttttttgtagaaaaattttagtggttcctttaagttatatatatgtgtatataaatatatatttatttatatatacatacataacatcactgtctatgtgtattgaaattttactagttttggtggagtatagaataaaaaacttacttccccttaaatccctttgcttttccctctttaatattaaacattaacaaatataaacattaaatattaataaatataaatattaaatatttgctttatattttgagaaccacagaagacaatgttttgcttcaacagtcaaatgtaatttagaaaacataagaggaaaaggaaagactatttacctatggatttcttctttcctctttcctgattccttttttaaaaacagtcatttctgttttaggaacttcttttagccactcttttagtataggtatgctggtgaaaaattctcctagattttctttgtctctaacagtctttatttcttcttcattactggagcataatttagcactgacagttcttttctttcagcatttaaatcattgcctctgtgatttctgcaaggaatttgctgctattagaattatttttttccaatagatgaggtgtcatttcttgctgtgttcaagagtttgtctttagttttcagaagtttgattatgtatcttggcatggatttctttgggcttatcctgtttgaggtttgctcagctttttgaatatgtagatttatatcctttgtcaagtttgagaaattttcggtcattatttcttaaaatactctttcagtcccaccttctttcttctttccttctggaactctaaccacagcaatgtttactcttttattatagtcccagagtttcctaagcttttgtttattttttttgcactctagtttctctctgtttttgagattgggtaatttcaatgtatcttcaagtttactgattctttgctctgtcttctctattcttatgttaagcccatccagtgagttttgaattttgcttatcatattttttagttccagggtttttctttgtttcttctttttatatttactatttctttgttgacacttcctatttcttttcctttgttttaaacatgatggtaattgctcattgagatgtatttatgatggctgctttaaaatctttgtcaaataatttcaacatttgtgttatctcagtgttggtatctgttgattgccttttctcattcaagtaaaaacttttatatttcattgtatgatgactgatattcagatatatgctgagcatctaattattatttattctgttttgttgttgttgttatatcatgcttttaaatttatattattttatttaattaattactttgcttcttccaacttttattttaggttcagaggttacatctgcaggattgttacatgggtaaattgtgtgttgctggggtttggtgtacaaattatttcatcatgcaggtagtaagcataataaccaataggtagtttttggttctcatcctcctcccaccctcaaccctcaagtaagccccagtatgtattgttcctctctttgtgtccatatgtactcaatgtttagcttccactcataagtgagaacatgaggtatttggttttctgttcctgcattcatttgcttagtataatggcctgtggctgcatccatattgctgcaaaaaccatggtttcattttgctttctggctccatagcattccatggggtatatttaccacattttctgtatccagtccactgttgatggacattttaggttgattccatgactattgtgacaattgctgccatgaacatatgcatacatgtgtctttatggcagaacaatttgtattcctttgtgtataatatacccagtaatgggattgctgggtcaaattgtagttctgtcttaatttctttgagaaatctccaagctgcttcccacagtggctgacctaatttacattcccacgagcagtgtataagcattcccttttctccacaacctcaacaacatctgttgtttttttgactttttagtaatagccattctgactggtttgagatggtatcttattgtggtttttaatttcccatttccctgattagtgatgttgagcatttgtccatatgtttgttggctgcttgtgtgtcttcatttgagaagtgtctgttcctgtctgtattaggctgttcttacactgctataaaaaaatacctgggtcgggcatggtggctcatgcaggtaatctcagcactttgggaggccaagggaggtggatcactagagctcagaagttcaagaccagcttgggcaacatggggaaatcctgtctctgctagaaatacaaacattagccaatgtggtggtgtgtgcctgtagtcccagctacttggaaattatgaggcaggaggattgcttgaacccaagaggtcgaggctgcactgcacccactgcactccagcttgggtgacagagcaaaaccctgtctccaaaaacaaacaaacaaactaacaaaaccaagtaaacaaaaagccaatattaggtaatgtataaagagaaaaggtttaattggcttatgattctgcaggctttatgggcagcatggtgctggcatctgctcggtttctagggaggaagcttacaatcatggcagaaggtgaagtgtgaaatgggagggagcaggtacatcacatggtgaaagcaggagcaagagggatagagtggtaggagaggtgccatacacttttaaacaatccgatctcacaagagctcactcactattgcaaagataactccaagccgtgagtgattggctcccatgacctgaacacctcgcaccaggtcctaccttcagcattgggggtgacaaagcaacatgagatttgggcagggataaatatccaaattatatcattctgctcctggcctctcccaaatctcatgtcttctcacattgcaaaatataattatgccttcctaacagtccccgaaagtcttaactcattccgactttaactcaaaaattcaaagttggccagatgcagtggctcacacctataatcccagcattttggaaggccaaggtgggtggatttcttgagcccaggagtttgagaccagcctgggtaatgtggcaaaactgcatctccacaaaaaaaaattagctgggctttgtggcatatgcctatagttccagctgtttgggaggctgaggtgggaagattgattgatcgtgggaggtttaggctgcattgagctgtgatcgcaccactgcagtccagcttgggtgacacagaaagacttcattttggggaaaaaaaaaaagtctgaagtccaaagtctcatctgagataaagcaattcccttccacctcatcaatctggatttcactgtcgatgtaactatcagcattttggtcacaaccatttaaccagtttctaagaaatttcagacttgatcatatctgtcttctgagccttcaaagttcttccatcctttacctgttacccagttgccaagtcgctttcacattttccaatatctttatagcaatgccacactcatagttaccaattttctgtgttaggctgttcttgcattgctattaagaaatatctgaggccgggtaatttattagaaaagatgtttaattggctcatggcttttcagactttatagtaagcctgatgctggcattaacttggctcctagggaggcatcaggaagcttataatcatggtgggaggtgaaaggggagcaggaacatcatgtggtgaaagcaggagcgagagagagagagtgggaggaggtgccacacacttttaaacaaccagatatcgtgacagttcactcgctatcgcaaagacagcactatgctgtcagggatccgttacccaaacaactcccaccagcctcacctccagcaatggagattaaacttcaacatgagatttgagaggggacaaatattcaaactgtatctatgttttttttccccattttaaaagggagttgtttgttttttgcttgttgatttgtttaagatttcttaaagattctggatattagacctttgtcagatgcatagtttgcaaatattttttcctattctgtaggtcgtctgtttactctgttaatagtttattttgctgtgcagaagctctttagtttaattagatcccagttgtcaatttttgttttagttgcaattgcttttagagtctttgttataaaagctttgttaaggctgatgtccagaatggtagttcctaggttttcttctagagtttttatagttttaggttttacacttaagtatttcaaccatctcaagttgatttttgtatatggtgaaagaaaggggttcagttttaattttttgcatatggctagccagttatccccagcaccatttattgattagggagtcctttccccatttcttgttatggtcagctttgtcaaagatgagatggttgtagacatgcagctttacttctggcttctctatttggttccattgatctatgtgtctattttttttgtactagcaccgtgatcttctggttactatagctttgtggtatagtttgaagtctggtagtgtgatgccaccagctttgtttttttgtttaggattgctttggctattaaggctcttttttggttccatataaatattacaacagtttttactaattctgtgaaaaatgacattggtagttttataggaataacatttaatctgtaaatttctttgagcagtatggccattttaacaatactgattctttctattcatgaacacaaactgttttaccatttgtttgtgtcaactatggtttctttcttttttttcttgagacaaggtcttaccctgttgatcaggctggagtgcagtgccacaactatagttcactgcagccttgaactcctgggctcaagcgatcctcccacttcagtctcctgagtagcggggactataggcattcaccaccacacatggctaattttttaggtttttggtagagatggagtcttgccatgttgctcatgctggtcttgaactcctgagctcaagcaatcctcctgcctctgcctcctaaactgctgggattacgggcatcagccactgtacctggccttcaactatgatttctttcagcagtgtttttaattctcattgtagaggtccttcaccttcctagttagccatatgtctatgtattttattcttcttgtggcaattgtgaatgagattgcactcttgatttggctctcggctaagatgttattgttgtatagaagtgctcctcattttagtacattgattttgtattcagaaactttactgaagttgtttatcagttctaggagcctttgggcagagactgtggagttttctgggtgtagaatcatatcatttgtgaagagagatagtttgacttcctctcttctatttggatgccttttatgtctttctcttgcctaattgctttggtcaaaacttccagtactatgttgaataacagtggtgagactgcacatccttgtcttttctggttcacaggggaatgcttctagcttttgcccattcattatgatgttggttatggggttgtcatagaaggcttttattattttgaagtatgttcctctgatgcctagttagttcaaggtttttttcttttttttctttttgagacagagtctcgctttgtcacccaggctggagtgcagtggtgcgatctcagctcactgcaacctctgtcccccaggttctagtgattctcctgccttagcctcctgagtagctgggattacaggtgccaaccaccatgcctggctaatttttgtatttttagtagagatggggtttcgccatgttggtcaggctggtcttgaacacttgacctcaggtgatccacacatctcggcctcccaaagtgctgggattacaggcaggagccaccgtgcccagacatatttatttattttcatatgttgaaccagccttgcatcctagaaaataagactacattactgtggtggataagctttttgatgtgctgctggatttggtttgcaagtattttgttgaggatttttgcatcaatgttcatcaaggatattgtcctgaagttttctctttttgttgtgtctcttccaggttttggtatcagaaaaacactgccttcataaaatgtgttagggaggcttctctttttctagaattttgggagtattttcaatataattggtaccagctcttctttatatatctggtagaatttggctgtgaatctctctgttccagggccttccctgttggctgtttttttaaaattactggttcaattttggaactcattatttatcttctcaggtattcaatttcttcctggttcaatattgggagtttgtgtttccaagaatttatccattccttctagattttctagtttgtgtgcatagaggtgtttacaatcatctttgaaattttttgtaaaaaatatttctcttccctttggcatttctgatggtgcttatttgaaagttctttcttttttttctttgttagtcttgctagcagtgtatcaatcttatctattctttcaaagaacaagttgtttggtttcattgatcttttatatggatttttgtgtctctatttcattcagttcagctctaattttggttatttttgtcttgtgctagtttaggggttcacttactcttgtttttctagttcctcgaggtgtgatgctacattgttaatttaagatatttatatcttttcgatgttggcattttgccccataaactttcctgttaatactgctttacctgtgtcccagaaattccggcatgttgtatctttattttcattaatttcgaagaatttcttgctttctgtcttaatttcattctttactcaaaagacattcaggagcaggctgtttaatttccatgtaattgtataattttgagagatcttggtattgatttctatttttattgcactgtggtctgagagtgtgattggtatgatttttaaaaatttgtttagaattgctttatggccaagtgcatggttgatcttagagtatgtgccatacatatgcagatgaaaagaacgtatattttcttgttgttaggtggagtgttctatagatatctcttaggttcatttggtcaagtgttgagtttaggttcggaatatctttgttagttttctgcctttataacacctttagaggggtgttgaaatctccactataattttgtatttatctaagtcttttttgtaggctctaagaacttattttctgagtctggatgctccagtgttggatgcatatacatttagatagttaatcttcttgttgaattgaacactttatcactttgttacaccattttttgtcctttttaattattgttttaaagtctgttttgtctgaaataagagtagcaacccctgttcttttttgttttttatttgcttggtagatctttccttatgcctttactttgagactatgagtgtcattgcatttgagatgggtctcctgatgatagcatacagttgggtcttgcttctttatccaatgggctactctgtcccttgtaagtggggcattaagcctgtttatattcaagttataatattgatatgtgaagatttgatcctgccatcatgttgctagctggttattccacaggcttgattgtatagttgcatatagtgtcagtggactatgtaattgtcttttctgtggtgtcaggaatttttttttttttttgagaccgcgttttgctcttgttgctcaggctggagtgcaaaggcgcgatctgagctcactacatactctacctcctgggttcaagcgattcttctgccttagcctcctgagtacctgggattacaaatgcatgccattacacctggctaattttgtatttttagtagagatgggatttcgctatgttggccaggctggtcttgaactcctggcctcaggtgatctgcccacctcggccttccaaagtgctgggattacaggcgtgagaaaccatgcctagccaggtaatggtcttttgttgccatgtttagcactctcttaaggactttttgcaaggcaagtctggtggtaataaattcccttaacatttgcttgtctgaaaaagattccgtttctccttcgcttatgaagcttagtttggctggatatgaaattcttgattggaatttttttctttaagaatgctgaatataccagcctggccaacatggtgaaaccccatctctactaaaaatacaaaaattagccaggcatgctaatgggcgcctgtaatcccagctattcgggaggctgaggcaggagaattgctttcacctgagaggcagaggttacagtgagctgagatcatatcattgcgctccagcctgggtgacaagggtgagactctgtctcaaaaaaaaaaaaaaaaaaaaaaaaagaatgctggctgagtataggtccccaatctcttttggcttataaggtttctgctgaaggttctgctgttatcctgatatcaccccctttgtatgtgacctgtcccttcgctctactgcttttaagattttttctttcatgttgaccttggagaatctgacgacaaggcgtctagaggatgggtgtcttgtatattatatctctggggttctctgaatttcttgaatttgtatgttgacctctgcagcaagattggggaaattttcaggaacgatattcataaatgagttttccaagttgcttgctctctctctttccttggggatgccagtgaattgtagatttggtatatttatataattccatatttcttggagattttgttcattaaagaatatctttttctttatctgactgagttgatttgaagaactggccttcaagttctaaaattgttttcagtttgatctgttctgctgttaatactgcccattgtattatgaaattcttgtagtgagtttttcagctctaggagatcagtttctcttcttttctttccttttttcttttctctcttctcttctcttcttttctctcagagtctcactcggttgcccaggctggagtgcagtggcaagatatcggctcactgcaagctccgcctcccgggttaatgccattctcctgcctcagcctcctgagtagctgggattacaggggcccgccaccatgccccccggctaatttttttgtatttttaatagagacggggtttcaccgtgttagccaggatggtttcgatctcctgacctcgtgatctacccaccttcggcctcccaaagtgctgggattacaggcgtgagccaccgcgcccgaccctgattctttcttaaaatggcaatttcatctttcagctcttgtgttattttattgatgccataagttccttagactgtgtttcaactttcccctgaatcttgatgatcttcattgacatctgtattctgaattccatgtctgtcatttcagtctggttatgaaccattgctggggagctagttcagtcatttggaggtaagaagacactcttgcttttagagttaccagagttcttgcattggttctttctcatctgtgtgtgtgaagttgttgtcctttgtatggagctttttacttttatattctttgatgccttttgtggtttgattgtggtattagttgtgcttagttaatttcattcgtttttggatgatttcaggggtccaagggttagctcagcactcctgggctgcatgctgtaccaggctgtaaccttgggaaattgggaccaggtctgaggcggttttctctagcccctagaggttaagtacctcctgggttggaaggaatgaggtgttcctggtccactggcaacaaaactgtgctggcaaaggcactttggcggggtggcagtgggtcagtgagggtccttgtgctcacatacgtgctggtggtggggtagtggcaagtcctgcacaggcatgcgtgctggtggtggggcagtgatggggtcagtgtgcatgcatacaccagtgagtcagtggctggaggctgcaggcaaaggcatgacagcaaagcagcaggtagaggctgccagtgagtgcatgctggtgggcgctcactgacagggacctgccttcaggagctctccagctgttaggcagggtctgccatcaaaatagcaatggctgtggctgtcaaaaaatgccttggctgggcagctgaggcagtgctgcaagtttgtgtagccaggcagggaatttggcataggccagcagacaagcgagtgcttggatcagattgttcccatcccacaagcaagagagccctgtgatgtccaggtctgtccatcaacaaaggcgaaagccacctagagatgtatgatatttgggggatgggcacccatgccatgctctgctgtagccattctcatgccaaaccctgtggactctgtgcaggctagaattctgtctctttcaactctccaggctgttctccctgccaccttaactgtccatgggggatgaggggtctcctgcagctaagattctggaggtctgtggtgtgagttggccactccatgaccatttaacttactccttccccaggagcctctccaggccaggaacaagttctggtgcttggcaaccctgtgcagggttaccagcttccttccctttcagcctggggtctgcattctccttccatcaactctcaatgccttctttctgaaaatttgttcagagtgtgccagtcttcttgatggtctggtccctcactgggagaaggtcttcttgtctgcgtctggtcggccattttgttttagtatttattaaataatgaaataataataatttgaaaaaattaaattattattatttaaaactctagatcttatttaaattttctatttaaccatgcctcagcagacattgtgatgcagagggagggggatgtatgaaggaattgcctcatttcccactcagcttcctttgatgctcaggtgagggactaatgctcattactactgcatggaggttaggcctcttctgataacactctggctgaaggtactttgttactgctccccttttggcctccactgacatcatggggtagtgatttcattactgcttcgcagtggtgaaagacttgacttcccactacctctcctcagacatggttctagtagatggggagagttattcctcattactgggtggtagttcatgcttcccactcagcatattcttttttttttttttttttttttttttttgaggtggagtctcgcttgttgcccaggctggagtgcagtggtgccatcttggctcactgcaacctctgcctcctaggttccagcaattctcctgcctcagcctcctgagtagctgagattaaaggcatgtgccacgacacctgactaatttttgtatttttagtagagacggcgttttgccatgtttgctaggctggtctgaaactcctgatttcaggtcatccacctgcttcagccttccaacgtgctgggattacgagtgtgagccactgcacctggtgcctattcagcatattctgacaccaatctagtagggaattgggccttcttacagcctggtaagcatggaagtcttttcagttgggatttattgtcttcctggatttgctgttttcccaagttgtcctcttattgattattttactagggagagcaggattttcttggagccttttaaaaaacttgcacttgttggcaggttgccaggttgctggcttcttccaagtccatgatatatgaagcaaaaaaaaaaaaaaaaaaaaaaaaaaaattgagagagctcactcttgtatcattccttttgtcctgcatttctgagcccacctgtcgtcttctctctaattttcagagtctttttatgtttgttttatttgtaatgcccaggtatttttttgtttgttttagccatatttagctggggaaaaaagaataagtaagtctgtcccatattggtctggagcgtttacatatttttgaagccgggttttgttttccagtgtttggctattgccaccaattttgtgcctttggtggatacaaaaattttgacctctatgtcttcatgtgcatcactcacaaaatcatggagggggccaataactggttccttctgtgtgtcactaaatgctttcataattttcattttgtgatttgacagaatttttgtttaatgtgctttctaagccctatagttctcttcagaattccatgttactctgtgtgctttctaatctgtattcataaaatggtaccattaatttctaagatttttttttacaatttttaatgttattcctttcatgctttcgcatgaacactatctgtattgccttcatttgctccacctcatttaattccctgttggcatcactatagttctttcccaacttttacctttgggttagtcgttttagcaatgttcagtttgctacattaaattcttttattcagttgacctttgtttatactctggcaaatgcccaagtttagactcacttcattttgtttctttttctgtgtttcctaattgctcctggaggaacacacggaacaaagtagattggtcccattaccacacactactaaaaattccttcctaacaattgaaattgattctgtaattcaatctcctgaaatgaattcaacttaaaagatgacttgaaaatatacttgatccttgttatttgcagattccatatttgcaaattcacctactcactaaaatttatttgtaacccccaaatcaatactcaaggcacttttatgatcattcacaagcatgcacagagtggcaaaatatcttattactcaatgagcatattcttacctgaggttgaaaaatgtgatactgtgcctttttgtttcagttctcattctgtaaacaagtgtcttttcttggtctacatagtgctacatttttcacatttttattatctttgctggcgattttgctgtttaaaatagtccccaactgtagtgccaaagtatagtgcaagaaggttgtgatgtgccatatggagaaaatatgtatatttggtaagctttgtttagttataagttttagcggtgtttactgtgagtttaatgttaatgaatcaacaatgtatattaaatagaacgtctttaaacagaaacacacacgaaatctgtttatgtcttgagcagttgacaaaaatgtgaccagagtctcctggaaaaccaaccctgtatttctcctaagaacaaggactcaacagtcattaattcagcatttgtggtgacttcacagaacacgactaccatgaataatgagaataacctgtattttatttgtcttcttgacggtcatggaatcattgatggtttagatattatgctagaccttcttttgtcctaatcatcatcatcctacttgcctccaactttcctgaaactgttgaaaacatcgtgcacttttacatttatgatcatccattattttctttattcaactatctcggtttctatagtctctatagtaatgtccttcctaaaaatttcagagaaacagatgtatgccctcttaatcttttattttataatttttattataaaaatttcaatggtatgcaaaaatagggaggataaaataatgaactttcatgtactcatcacctagttcaaaaatttacaactcatggccaaccttacgttatccgtacataccctgataaaatcccctcatcccctttccctaccaaaatatcaaatctattttgaagttaatcccagatgttatatactttcatctgaaaatgtccccattcaaaaatactattttgatggtgatattagaggtacacgctttacaaactttgtgagctacagaagagaagccaaatttgccctatgattacaatattctactttcttatctctgggaagacatggcacccatttttttgggggggagggatggagtttcatgcttgttacccaggctggagtgcagtggtgtgatctcggctcactgcaacctccaccttctggatttaagctattctctcgcctcagcctcctgagtagctgagattacaggcaaccgccaccacaccagactaatttttgtatttttagtagagacaaggtttcaccatgttggtgaaaaattccttcctagcttccaggctggtctcaagctcctgacctcaggagatctacctgcctcagcttcccaaggtgctgggattacaggtgtaagccatcttgcccagcctccatttaaaaaatgttcatgtctagcatccacagtttttaccacttgccttgctctttatattttaatatcacaaaaaccactaataacctcatatgtaaaaatttttccttgaatctcctactgtttctcatctcagtggtatttggcgaccttgcctttcttaagacatatcccttgtttgaatttcataattctgaaatttgctgatttctttcctcctcctccatctactcatttctggctgtatcctttgattaatctttctctctctctctcaatctggctatgctcaagattcagatctcagataaagtttttatctgctgtctatattctcactcaaagaagccatcttttctttgaactcagctatcaccttaatgagtgccaaacctgtgtctccagaattcaactcttgcccatatttagtcttacatttctacctacttcaaagtgatttctatttatatattttaagttcttaataggaaatgaaaatttgtatatgtgccatttgaaactcaacaggcatcatgaaatgttgcctgggtttttaagtttctcgctcatattattagggttcactattagagttttttttactcttatgtttcctccacatgtattcagttaagtcctagactattttcccactttaccatatcttttatgtttatttcttatgcccctattatttctgttaacaccctaatctattccctcatttctttgtgtcttaatacttccacggcttcctgtttggcttcttccaattttagaagtttctgaatacacttcctgttctgtttctcactaaaccattcactaaaaataacaggattaatgagacaaatagagatagagacagactggtccctcaaaagctatgcaactttataactgaagaattaacaaatataataattggtacctttaaaaatagcttgcacagtgtaggcaggcaaaacgcccaaggtctggtggcttactcagggcatgttaaaaatgcaaagaaaaataatgtggaaacacaggtttgctggtgctaaggcaatatacacagggaagtgtagtcctgagcagaagaggaaatgcaacctaaaactgatacaaagctaggatacatctctctggggagggagttttgggtacaggcactcaggcattttcttaaaacagtgccccaaatgtgtctgcctgtgtaatagctgagttgaaagggttttccttttcttctgaagtttataattccactcccattattctggctcccttgcctaaaaaaaagcatatctaaaccatcataatttccatcttctactgacataactctgccattcactaatcaaatgtgagctaattagtgctggtagaatagactctatatttttttctatttgatacttgctggacatcaccttacttttcagcttgtaatgctatttactgctatttatatactattatttatattatttactatttgtatactgctatctctttaaaataattatttattctcggactcatttattcctgtctcttatgctgattaaagctttgttttctcttgtatcttctatttctctatcctgattttctctgcctgcatatagacttgggattttattatcaaaattatttatttttgaatagcttcatatggcatatcttatttctataagcagattgcaggtttctagaggacaagatccatgtgtttataatactctttttatatctcctcctacatacgagggtatcagtaaatgcttattggttagttgatttaaaatcacaaatgtattatttcaaatgtactattatattagttaattttttaaatggacaaaagaaaattcacaaggaagttagcataacgtagggaaaaaagcatgggcttctgaattagatcgctctggattcaaattcggggtctgccactgattagcacgtgatctcaggcaaattacttaatgtttctgagtttcagttttcttagtaacccagaaaaaattaacctagttctatgttttttgtaaacaagaattacatgaattaatgagataatattttaatcaattaagaacttcatagagtgagtatgaatacttaatgggtggtcaataattagaagcgccaggatcttgaggaataatcagccagtacctcattattacaagccatataaagaatcaaaactctggagtttgcaggatataaataatgagaatttgtgattttatatatgcatttcctaagttctgccttttgctagactaagcactttacattcactgtcttacatcatcttcatagcactcatcacaggtaggtattattaggagcatttacagataaataaattaaaggtcttagccagcatggaaaggccaaacttgagatagaaaccctggtgtctgactctaatgtctgtttttttttgtttgtttgtttttttaaaatcagtaatagactcttcactcccttttttggggggttatgttacactaataaagagtatagacaaaataattagggagttattttgtcagatgtgtcacataagttaagagtacagttcttcaaagagatggaggcttcaatctcattgttttgaaggtttcaaggtatttcaaggtttcaaggtttcaatctcatcagttttcaaggtattggaggtcctcttttaggtggataactgacatagatggagaaaatcacttatgcatgcgaacacacggaatacttttgaaaattacccctttcattacattcttaagttagaaaaatagccaattcctctgtaatgaactgaattatgaattactaatttctgtcttctcctttagggtgactctggaggaccactggttagttcagatgctagagatatctggtaccttgctggaatagtgagctggggagatgaatgtgcgaaacccaacaagcctggtgtttatactagagttacggccttgcgggactggattacttcaaaaactggtatctaagagagaaaagcctcatggaacagataacatttttttttgttttttgggtgtggaggccatttttagagatacagaattggagaagacttgcaaaacagctagatttgactgatctcaataaactgtttgcttgatgcatgtattttcttcccagctctgttccgcacataagcatcctgcttctgccagatcaactctgtcatctgtgagcaatagttgaaactttatgtacatagagaaatagataatacaatattacattacagcctgtattcatttgttctctagaagttttgtcagaattttgacttgttgacataaatttgtaatgcatatatacaatttgaagcactccttttcttcagttcctcagctcctctcatttcagcaaatatccattttcaaggtgcagaacaaggagtgaaagaaaatataagaagaaaaaaatcccctacattttattggcacagaaaagtattaggtgtttttcttagtggaatattagaaatgatcatattcattatgaaaggtcaagcaaagacagcagaataccaatcacttcatcatttaggaagtatgggaactaagttaaggaaatccagaaagaagccaagatatatccttattttcatttccaaacaactactatgataaatgtgaagaagattctgtttttttgtgacctataataattatacaaacttcatgcaatgtacttgttctaagcaaattaaagcaaatatttatttaacattgttactgaggatgtcaacatataacaataaaatataaatcacccatttgcttgacattatgatatgataatccacaaagaaggggaagatgggaaaaatgttactagtcaatttattgtaaatttttttaaaatttgaggctaggatgaaaattaatttaataacaatcagcatgcttatgtactaaaataattgcgttgtggaatgggagggaacgaagagttcaaacaattgactggaaaggttttattcgtctaagactttcccaaacagcaaatccttgaagggaatgagatccaggtgttagtgtacagtctagtgatgcaactgaactggggctcagacctctattttgagatgattgtagatatttttcttcccctgctgctgtgtttacagttcatacatggttaatggtcctgttagactcctcttcgctgagatggaaagataccatagagaaaatatcctggaagctgcctcactgctgcatctagtgtgacactgaatggctaactgcctggataacaaaactgaagagtaaaagcatgatattggccaccttcatgatttttagttttggtaaattattactgagctgttagagacacagctttcaagtaatccagaccgtaatgaagttaggactggtaccatgatgtacggcatgttaatggtgagatttcaccaagtctgtcctcattgcatatagctactcatataagttctatattgtacaataattaccctgaaaaccagtattgccacgaaaaatttaagtttattgatctgaataacactggagtatgaactgataacatttaggcacttggcaaaaatatgaaaactgacatgaattgatagtgctaaatattttgcataagctatttttgtttcatttagcaaaatgctctgggaaaaaacaaaattgaggaaaaccttgaattttaagcaaggatataagtacctttaaaactactctcagtgttctgttaaaaatggattcctcttgtttcagtgtattctgtagttgggcctctaggtggcacccacaagctgtaggaagctatggggaagcctgacatcaagaaggatgtctagatctgtaagtaataatgagaactgtacctgaaattagagtctcgtgaaaccaaaagaatacagtttttctttgcaaatggcgtttaaaaattaattcgtgttgatttacatcattattcgtatttttcaaatttctggacatttgattccaaactaaaataaaatttatgttgcatgatttgaggaactccctctgcaaaagcacctggagcaatttaaattaagaagaaattttaaaagcttaattttgcaatgacatcttattcctaagagaaatacttttgatatttccttctacaaaggatttgagaaatagaagtttgggtcaaagtgaaaatatgagcgatagttcaaactttatgtacatagagaaataggtaatacatttctaaaatggtaacttcttttgaaaagtaattaccaaagggttttatctgcatgtctgtgttaactgtttcattggagatagttaagaagatgtgacgataatatttattacttttttcaagagggcaggcagttcctcttctatatcttcgatctctcttcctacagcactagtaaagtactctgtatataacagtccttcaataaatgttgttgaatgactcttttatttttacattatgcagaaaacatagctttattattatttacacattgatttttaaaattaatcccagattttacactgagtgaattaagccggttactatttatctaagcctataatctcacccgtaagatagagatgatatttgctcaaatgattgttgtggaaataaaactgtgaatgtttaaaaagtgcttagcacagttcttggaacattagtaggtgttcaagagaccatagtaataataactgttgctataatgaaactacactcttgttttaaaaaatatggtatttgattataacaggctgaataccttttttttttgaaatgacaagataattagaccaacaaaatgtgctagttaaaaaaatttctgattctacaaaaagttttactgggataattccgaaacatatttatcaaagtggtctgtcaatgtgagggttcattctaacttttgacttcaattttaaaaaatgataaactttattaaccaccgagtggctggattatatcaagatctatggtgtagttcaaatgtcgcctcttccctgaagcctttttttacttcctcaagtggatgtactatacgtttcttctgaacttccttaccattaattttttttattttcagataatcattgattcagatacggttaagatataactgtaagatataattcacagagattctgtgtaccctttactcagtttacctcaatagtaagatcttgcttaggtgtagtataatattacaatgaagaagttgacattgagacaatccattaactttattaggatgcaatcaattatatatgtgtgtgtaggtgtgtgtgtaattagttctatgtaatttaattacatatgtagattcatgtgattaccaagatacagatagtttgttcacaaggctacatcacgctaccgacagccatccagctccctccctaggcctgtgtctagtctctaatccctggcaaccactaatctgctctccatctttataatttttattgtttcaagaatggtatataaatatattatacaataagtaactttttcaggttggctttttcgctcagtataattttcttgagatctgtccaagttgttgtgtgtgtcagtagttaattctttttttattactgagtagtattacatgatagggctgtacctcagtttgttaactgtatacccactgaagggcatttggattgttctcaggttttggctattacaaataaagctgctatgaagatttgtgtgtaagcttttgtgtggacataagttttatttttctgagatttatggcctagagtatgctgggtcatacggtaagtacatgtttagatttttaagaaacggccatattcttttcacatggctccttactacttgtaaaactctctgtacttagaatatctacctgtgtatttcagatgtgcagatagatgtgatttcaacaactagactgtaaactccatgagggtggggacagtaactggttcatttttatatccttcacagttcacaggaaactataatattgtttatggcagttgttctataaagatttattaaataaaaataaagagtaataaaagcaaacaaataaatatacatgaaataaaaaagaagaaatggctttgggtagaaaagaatgaacagtatttccttcatgaaggtattactgctcaatttctgtaattctgcatggactctaccatggcacttccatgtatcttatgttggttgatataaagtctgtttttcacctttccacagggtacacaatcaaacatagactaaagacatggttgatatggagaatctctctttatatctgaatttagtttctgatacatgttatatttaagagttttctgacacatctgtatcagcttctactgtatttgtggaatggattccagtttaggagcacaatcaataaatatttgttgctcttactttttataactatgattctataatttgtcctaatgtaatttttattatataactcaaggtggagtgaaagacagagacctgtgaaatgtaatcagaagttctctcttaattgtccctaacacaataatcagtacctctttggcgtagatgtagtcagcttaaattttacaatcacagtactcactgccttgcatatacccctcacctgcttgttctcttgctccaccactctgtgacacttgctttttactatgatcctggtaaaatttaactctccacttactgtttttaaaaactaattaatttcccccaattttattaaagtataattggctaataaaaattgtatatagttacagtgtaaaatttgatgttttgatatatgtatacattgtgaaattatttaatcaagctaattaatatattcattacctcaatacttactattttttaaaagaacatttaatatctattcagcaatatctacttttaacaatttaaaaatactcaatacattattattaactgtagtctccatgctgtaaataggcctccagaacttatttcttctatataactgaaactttgtaccttttaatcaatatcttctcatttctaccacactccagcctctagcaaccaccattttactctctgcttctattagttcagctttcttagattccacatataagtgagatcatgtagtaatcagcactctgtgtttggcttatttcacttaacataatatcctccagattcatctatgttgtcacaaatgacacgattcccttcgtttttaaagctgtatcatattccaatgtgtgtatttctttattcttccaccaatggacatgtaggttgattctatattttggctattgtgaataatgctacaataaacatgagaatgcaagtatttctgtaccaaaagtgaaaaacagaatggttgtatggtacttaaagtatggtttctactgaatatttcaattaatcactgctgagataaccaaaatagtgtgtaaaaaacaagcaaatcagcaaaaccaaaattgcactttttcaaaatgtcagataaatgactaatcttttaactagactgaactcccataaaggagatgattcacattttaataataaagtcagatataatagtaaagacattattaccaatcatacagaaataaaagaattataattgtatattaggagcactggtatgtcaacaaattataataacttagatgaaatgaacaaatctctaaaagacacagtcatacagactcaagagttctaacacaattccattatgttcaaaggacacacttcgtatgatttcagtacttttattgagagacacggcctagcaatggcctatcttggaaaatgttaatgtacttgagaatattatatacagtcatgcattgcttaacaacagggatatatgaactgcattgttacatgattttgttgtgtgaacatcatacagtgtacttacataaatctacagggtgtagcctactacacacctaggctgtatggcataatctattgctcctaacttacaacctgtacagcatattactatactgaatactacagggaattgtaacacagtgggaagcatttgtgtatttaaacataactatacgtagaaaagttactgtacaaatacaatcatctaaaaaattaaaaaatggtatacctgttaaaattcttatcatgaatggagttttcagggctagaagttgctctgggtgagtcagtgagtgagtggtgaatgaatgtgaaggcataggacattattatacactaccgtagactttataaacaccatgcacttaggctacactaaatttgtaaacaattttccctcttcaatgaaaaattaactttagcttactgtaacccttttaatttataaactttaaatttcttttactttttgactcttttataatagcacttagcttaaaaacaaacatatttttcagccatacaaaaatattttttctttatacccttattctataagctttttaaaatattttaataatttattattttttacctttaaactttttggttaaaaactaagagcccaccacagctcagcaaggccactgtggccagactgactctctagattccctcctctctgggcagaacatctctgaaaaaaaggcagcagccccagtcagggacttatagataaaacccccacctcctgggacagagcagctgggggaaggggtggttgtgggcacagcttcagcagacttaaatgttcctacctggcagctctgaagacagcagtggatctcccagcacagcgttcaagctctgataagggacagcctgcctcctcaagtgggtcactgacccccgtgtatcctgactgggagacacctcccagtagaggccgacagacacctcatacaggagagctctggctgacatctggtgggtgctcctctgggacaaagcttccagaggaaggaacaagcagcaatttttgctgttctgtagcctccgctagtgatagccaggcaaacaggttctggagtggacctccagcaaactccagcagacctgcagcagagggccctgaatgttagagggaaaactaacaaacagaaaggaatagtatcgacatcaacaaaaaggatgtccactcagagaccccatcggaaagtcactgacttcaaagaccaaaggtagataaatccacgaagatggggagaaacaagtgcaaaaaggctgaaaatccaaaaaccagaatgcctcctctcctccaaaggatcacaactcctcaccagcaagggaacaaaatgggatggagaatgagtttgatgaattgacagaagtaggcttcagaaggtgggtaataacaaactcctccgagctaaaggagcatgttctaacccaatgcaaggaagctaagaaccttgaaaaaaggttagatgaattgctaactagaataaacagtttagagaagagcataaatgacctgatagagctgaaaaacacagcaggagaacttcatgaagcatacgcaagtatcaatagctgaaccaatcaagcagaagaaaggatatcagagattgaagatcaactcaatgaaataaagcaagaagacaagattagagcaaaaagagtgaaaagaaaagaacaaagcatccaagaaatataggactatgtgaaaagaccaaatctatgtgtgattggtgtacctgaaagtgatggagagaatggaaccaagttggaaaacactcttcaggatattatccaggagaactttcccaacctagcaaggcaggccaacattcaaattcaggaaatacagagatcaccacaaagatattcctggagaagagcaaccccaagacacataattgtcagattcaccaaggttgaagtgaaggaaaaaaatgttaagggcagccagagagaaacgttgggttacccacaaagggaagccaatcagactaacagcagatctctctgcagaaaccctacaagccagaagagagtgggggccaatattcaacattcttaaaaaaattttcaacccagaatttcatatccagacaaactaagtttcctaagcgaaggagaaataaaatcctttacagaaaaggaaatactgagagatttttgtcaccaccagtcctgccctacaggagctcctgcagtagtttctgctgccttttgttcagctatgacctgccaccagaggtggagtctacagaggtaggcagggctccttgagctgcagtgggctccacccagttcaagcttcctggctgctttgtttacctactcaagcctcagcaatggcgaatgcccctcccacagccagtctgccaccttgcagttctatctcagactgctgtgctagcagtgagcaaggctctgtgggcatgggacccgctgagccagggccgggatataatctcctggtgtgctgtttgctgagaccattggaaaaggtgggagtgtcccaattttcctggtagagtctgtcatggcttcccctggctaggaaatggaaatcccccaaccccttgcacttccagggtgaggtgatgccccaccctgcttcagcttgccttctgtgggctgcacccactgcccaaccagtcccagtaggatgaaccaggtacctcagttgaaaatgcagaaatcacccatcttctgcattgatcatgctgggagctgcagaccagagctgttcctatttggccatcttggttcttcactatagacatgttacaaaggaagatatacaagcagtcaacaagcatatgaacaaaaagatcaatatcactgatcattagggaaatgcaaattgaaaccacagtgagataccactgatcattagataaatgcaaatcaaaaccacagtgagatactatttcacacaagttagagtggctataattagtcaaaaaatagcagatactggtgaggttgcagagcaaagggaacacttatacactgttggtgggagcgtaaattagttcaaccattgtggaaagaggtgtggtgattactcaaaaagctaaaagcagaactaccatttgacccagcagtcctgttactggatatatgcccaaaggaatatatatcattctaccataaagacacatgtacatttatgttcattgcagcactgttcacaatagcaaagacatggaatcaacctaaatgcccatcaatggtagactggataaagaatatgtggtacatatacaccatgggatgctatgcagccataaaaaagaatgagatcatgtcctttgcaggaacatggatggaactggagaccatcatccttagcaaactaacacaggaacagaaaaccaaatgctgcatgtactcacttatgagggggagctaactgatgagaacacatggatgcaaagagacaacagacactggggtctacttgagggtggagggttggggagaagaataggatcagaaaaaataactattgggtcctaggctttgtacctgggtgatgaaatagtctgcacaacaaactcccatgacaggagatcacctatattagaagcctgcacttttacccctgaacctaaactataagtttttttttaaaaaaaatcttaagaaagaaacataaagtcaaacgttttgtgaatattatgtcaaaattatgtgcttatcattttgctgctgttccttttttaaaaatgctttttttatctctctgtaaaataatggtgttccctttctaatgcaaacatactttcagatcctaatcatcggggtaaacattctttttaaaactattgtttacaaaagtaaaaatctgactttgtccatgcagatcatctattgacaagtatttttcaacaacataattttaaccttatgacatcagttttaatagcagtcattacactattattccaggtgattctgggacacctgagtactctgtgtaattgaagttatctgtagccacatttaatatgacatgttcaatgtttggtctcacaagctcactgcttagagtcttcttcatccacccaatattgaagtaatgaaatggctgttaatagattcatcactgatctcattctgcgacatctttatcagaataatataaaatcaatgtaagaaatttggtgaaattatgaaaatttaggaaaaaataaatttcatttataaaatctgtgtgctttcattatggttttattctatttatataactcaaagtacatatattatgtttacataaaaattttttatctcattgcatgtatcttttcttctgacacaaaaattgtgatatttttctgttcatcattttgttccgtagtattcaacaatacctgtactatggctgacagtgtaatttaacattttttgataaaacaattgtaatgacatggtacacacattgtatacattttaaatcatttctcaatgtaaaatatttgaattgtctccagtgtttattttatgaatgtctgccacaaatattgaatctgaccatcgtgatttaggtgttctctgtatagtttcatatgagtatattatgaagccaatgtctatatgcatttttataatacttaatacttttccccaagtgtctgattcttttaaaatatgcaatcattatctgagaatctaatacataatggaaaagcaagaaaatttgtgacaaaaattattttatgtaagaaagaagtagaggacaggctgcacaactattgacctggattcgaacctaccttctgcaaatgaataacaacagctagtattagtatttatcactattgttctaatagtcattcttgcccttgtcttccttctccacctactctcttcccccttctaatggcaccatcactttcctctaatgtgaatgggaaaattttttgagaataaggttagagtgcatagaattttcattggtcttacctctgcctttgtcctttgggaaattaccacatagagcctatgcaattttcattcaacatagacattgagttttaactcaagtaagatttcagttttctgttgctgcttataagaaggtagacaaaaagatctcttaaggcttatataataaagtagtgaggaatgcttgctttctgcttatgtctcaaaagaataacattaaagtaaaatatatgaggttcttttgtttcttcgtaaggaagatcatcctatatcctgacagaattcttttgtaaatctcagtgtagttttcagatgcaagtggtagacattatttggatcttattatacatgcattgttcatttttttttggtgcttctctgtcaggcagctgtgatgatgagtcccaagtttcccagagatttttactgaggtgtcctataggcgtggcataaggcagaaaacattaaaaggttaaactgacccttttatgctctaagatataaacctctgtgatctcactgacgaaagttttaaatgctagagtgaaagcaagtaaacattggctttggctgagaatattctggtggcacacatttatgtcgttgatgaatagtgtaccttgaaaagccttaacccttacatcgttagcatttcatcttgttcatctgactgcccaaaaatctatatttaaacaagtccacaggggatctgttctctaggactttgctggagaaccttgatgtgttggaaaactgttcctattaatagaaaaattatatctcgagtggctggcatatgttaactaatggatactattaatagtaataacaaaaataaaaaatcattacaatattactactatttgaatcactatgtacgagagacattataagtgttttatctgtattaagtatattttcaacacaacacaataggaagaaattgccattattatagaagtaggcataattatctctatcaacattctagtccacttttccattatctgttgcataaactcatgcaaaatcttctaaatgatctacgcttttcacaatctggcctttttgtgatgtaatccattgacaacattgagagctttttaaagaaagggaatctgatcacatctctccatttcttaactctgtgcagtagctccccattgcccttaatagacacttcgatctccttataattatattgcttccacttacctctctagcaacatctgctactttactcagctttttcctgcatactaattagaaatcttaggaactgcctttacttcactacctgcttttctttttttgttttcctctccccctcttcttttcacctattcctgcacattactgaggactcactttaccaatgactttgagatctcttctagatgtttgcttagcattgtgaccttataacacttttagacttttcctttttacttgcttatagtctatctttcaaagtacaacgtaaggcatgagggagcagaaagtgcctacatttcttctctgaaaatcgagcacttatccatggtttatgctgatcacttcataaacattctttgaaggaatgacttatactttttttttactttgcacaatgaaggctttcattgaatcaaccctgttttcagagtctctttagtatccctctttgatatttaatgacactaaagtttacacagttgtgatgatatagaaacatatgagtttctaatggtaggtcactttactcgacctcccatattttctcttactgtgagtcaaacactctgaataaaaacatatctggccattccttctgaaatgcaaagcaaacaaatcaaacaggagtaaatttaccttaggcagggttttggctggtttacagtggagttcccccacaaaatcgacatttggtaagggtgggcaaagaaattcaaaatcccagtacgtttgaatgagccacacttcagctttccccattatctgaaataatgtacattaataaaataaatgtatacatatctttttatatataagcataacaattttcatatattgcatgttacttatatataaggaaagcaaagtgttcagataattaagaggaaattacatatttaatgtaacataagtatattcacaatcacaaatagttattgaaataagccactatggacttaaatatgcatttgtttcctctctaaagttgcagtagtaaccaatatagatttaaacagctctttgagctccacgattaattcatcttactatacttataaaaacagctttctacaaagcacaaaatctagtttccacaatttatcaagtcagtcccttgatccttggttctccaagtgaactgtgagttttctgagagtatggctgaaatccttgaacatactactgcttctagttcatgttaagattttaatgatattagttgtaaaatacatacatttaaaaatgatagctagtatatattcagaatttattgaaacagagatatgtgctcccccttaacttggcccatattttccctaataaagagaagtagttcaataaaatatagattaaaagcttgaatgttcactttcaacaaggtttcagttcacaaagcaaataatttccaagttgttagtgaactatgaacaaacactagaaacctcaaattttaggtttctgtttctgaaatagagccagtatacctctcaactgtgaaggaatccttctgtttatagagaaaaatattttaatacctaaataagaaaagtgaggtacacaaagagaaacaattttctcaatgctgcattaatagttatgctagaaatatgtgtagctcctcatctaaatgtctgccttcatcaagttgtttattgatatatgtattgccttttttaaagatgaaaaaagtatagtaaaatacttatatagttgcttaaagaaatcataagtgctttactttgtagttttttttttttaattcctgtagtgtcctataggagcgatggccaaagggttctagctgagcctataatatcaacatttctataatatttgtgagattgatagatcatcttacatttgccattcatcatttcatttaaacaacactatcttcttacattatatttatatacgctcaccttcaaaggcaaaaggaaagttagaacttattaaccattgattagaaacatgacttacctagaacttcactgtaaaacttctcccacttctcgtatcaaacatttgaaaccaaaagtcaaaataaagcacatgtattaaatttttaatcctctccacgaatgtcattttaccacttaattcagacagaacagcaggtatgcgggaagtggggaatagaagtcctccactatacttctcaagtgtgtagccaggagactgtcaacaaaggacatgtatttaacatgcctttaacatgctcagctagcagttcaccacaggcaccaagggcatctgcaagaacgacatcaaacattgactcttgtagttttgtcgtaattttcttgttcaaaactacatctttacagagattattaacacagtctgtagattcccaaaagagttcttgtgcttgtgagaaatatgaccaaaatgcatctttctgaagatcgtatatccatctattgatcagtttcacaacaagaccctcaaaattatttttaattagagatgttggataaacctcaaatctaatagcagatgatttactagggtgaataataatggaagccaaagatgacagcacagtcatcttatggcctctccaaacaagttcatccaggattgtctttatattcatccaatggctgtattctgtgggccacactagcacctttccacaactcccagaactaaagtgacaactgagttgtatcaggagaatatttgacatcgatttcatagttctcctggtgcaatgcaatgcttcttttcaaatcgctgtttctttctgtttttctcctacttatatctgaagataaatcaatcaagtgaaagtataactgctacaattcaaagtagtagttaccatataatttctaaattaccataggaattgtctgttaccatataatttctaaattaccataggaatttccagattgtttttcacagtggatgcttcaatttccattctcaccagcaatgtataagaattttaatttcttcccaaccttgccaacacttgggattatatttcgtttgattatagccagtgtgaatgaagtgatatctggttatgctttacctttctttgatatgaaatcatgttgagcatgttttgcctaattttggttgaattatttgtcttcttatggacttgtgtttttaatatctttctgatataagaaccttatcacatatatgatttccttgttttttttttattctttgggctgtccttttactttcttaacggtgttcattgaagcacaaaagtattgattttgatgaagtccaactaatcaattttaatttggttgcttttatttttgattttatatctcacaaaccatttccaagttacaaaaattagtacctgttatttattattagagttttatagttctagtgcttacatttaagtttttgatcacctttgaattagcttttgtaagtgatttgaggtagagggtcccaactcaattattttgtatatggataatcattattcccacttatatttgttgaataatctattctttcccccttaaatagttttgaaacttttgtcaaaaactttaaatgcatgggtgtatttctatattctaaaatccattccattgatctacatgtctatctgtaggcctgtatcacactctcttgattattgtatatttgtatttgtctttaaaagcaggaaatgtaagttttccagctcatttttattttaaattgtttcagttttttaaaaaatttttttcttcttgctttttttctttaagaggtagaggtgttactatattgcccagactagattcaaatttctgggctcaagcaatcctcccaacacagcctcttgagtagctggatttacagatgtgtttcactacacctagcttcttttggctattagtatgtctcttgaatatgtataaatttcagaatcagcttgtctgtttatgcaaagaagtgatctgggattttgatagggattgcattgatttggtatatgaatttggggagtagagtatggtaattatcacaatattaggtctttcaataaatgaagatgtgatgcctttctatttatttagatgttcttatttccacagcgttttgtagattttgttacagtggctagctagtcagacacaaacagggcagaagacggctcccacaccctaccaggaaagtcagatgaccatcagttaatggtcaggcagttgtcacactgtctcgctaaaataataattggttgcagccagccagagaaaggcagctttcctataaatagaaaaaatcaaatctggtaatcagcagcttcctgataagatctcaggagttgggtgagtgggctcacgcatgcacattaagaggccaaatggtggagtaagacattccggtggcaccagaaaagggaagaatgcctcaggggagcattcatatgactccagtaaacatactgtgcatactcatctcctaagtgctagcaggccatcacacataccagcaggtcaccctaaggaaagaatcaaggaaaatggaagcaggatcctggaagtatgccaacatataaaaccctaagtcaaaggtcaaacactgcactttaccttcaaaatggccacttggatataccccaagtgtactttcctttctttcctgctataaacctttttaataaattttcacttttgttctgaaacttgtcccggtctctttttttgccttgtgcccctcaatcaaattctttcttctgaggaggcaagaattcaggttgctgcagaaccacaaaaatttgctgcagtaaccaccactagtaataatttcacagtgagagttgtacaattttttgttaaacttattactaagaattatattttttcatggtattataagggtgattgtttaatcttcattttagtttaaatttccattgcaattttgtagattttttgttttcttatcttggatcccaaaatcttgttttattggtttacttgaatattttttagtggatttgtaaaaatttcctattacaagatcattatatatgccaatagagatagtttaacttctttctttctaatgtggattccttttatttcattttctttcttatttgttgactgaaatttctactgcaatattgagtggaagtgagaagagtcaatttagtgtgatgttagctgtgtattttttttttttttttttttttgagacggagtctcgctctgtcgcccaggccggactgcggactgcagtggcgcaatctcggcttccgcttcccgggttcacgccattttcctgcctcagcctcccgagtagcagctgtgtatttttttatagatactattgatcagttttaagatgttctcctttacttctagtttaagtgttcttatgatgaagagtattgaatttcattaaataagtttttctgcagttattgaagtgattatgcagttttttcctttattctaatgatatgatatactagttggctttttcagatgttaacataactttgcattcctggaataaaattcatttgtttatggcatttaagcttttcgtatgttcctgaattttctttgctagtgcgaaaggaaagtaaaaatcttgagacattaaactcactatgtcaaagagaaaagttaatcttgggaaacaaaccatgtaaaactggctcccattttgttcctaaacagataaatgcaaaaatagaaggccacatacctctccagagggcctccttcccaatttactcacaaggaaaatcacaaggtcctaaaacagagttctcttgacttttaccctgagagtataaattaacattttatatttgcaggtatataaaagacaggacttgaagccattgtgtggtttttagcataagggcttactgaatggtggttatgttttctcctcttttattttttggaggattaattattttaaatatttgatagaagtatagagctttgatattttctactctaccatttccagttattaccccactatttttttctaaataatatttcactggaagccatcagacactggcttttcttttatgggagactttttccttacagcttcaatcttgttacttgttattagtttgttcaggttttttatttcttcatgggtctatcttggttggttgtatgtgtccaggaatttattaatatcatctaggttttccaatttgttggtatatagttgttcataatattctgtaataatttgtgtttctgtaatctcagttttttgtctcctctttcacttctgattttatttagtgggtctgttctcactttttccaacttagtctagctaacagtttgttgattttgtttacttttacagagtttaccttattgtctgtggctgcttttgtactacagtggaagagttgagtaggaacaagagtctaaagggtttgcaaattccaaaaatatttaccatctgaggctttatagaacctattctgatctctgcaggttcattttttcctttaacctttctatatattcaatatatatttctatatatttctgtattactatatattcaatatattctatatattcaatgcaattttaataaaatagtatagatttttagtgagtcagatgatttatgtttaattatgttaataatgagttaataaattaatttgtatttccattttatttagaataggtgagtttgtttgttatgtggaatggtgcttctgttttaccttttttttgagaaatctctaaactgctttccacagtaattcaactaatttgcaatccaccaacagtatataagcatttccttttctctggatcctcactagcatgtggtattattattaatttatactttttagtaatagccattatgactagtgtgagatggtctcattgtggttttgatttgcatttctatgatgattagtgatgttgagcatttttgtcacgtttgttggttccttgtatgtcttcttttgagaagtacctgttcacatcttttgcccggtttttcacggggttacttgatttttgcttgttgaattattcaagtttcttatagattctagatattagacctttaacagatgtgtagtttgctaatatttcttcagtttacatctcacttgtgaattttgagttttgttgcaattgttattaaggacttagttataaattctttcccaaggctgatgtctagaatggtatttcctagattttcttcaataagtcttatagctttaggtcttatatttaaacatttaattcatcttgggttaatttttgcttggtgaaaagtagagatccagtttcattctttttcttatggctagcaagctatcccaccatcatttattgaatagggagtccttttctccattgcttatttttgttgactcagtgatagatgactataggtctgttgctgtatttctgggctctgtattctgtttcattgatttatgtgtctgtttttgtaacagaaccatgctgttttggtgtctgcagccttataacatagtttgaagttgggtaatgtgatgcctctggctttgttctctttgctgaggcattcttcagctatttggactaatttttggttttatggaaatttttgaatatttttttctaattctgtgaataatgacattggcattttaataggaatagcatttaatgtgtggatggctttggttaggatggttattttaatgatattgattcttccaaccctgagcataaaatgctctaccatttgtttgagtcatctatgatttatttcagcagtgctttgtagttcttgtagaaaacttttgtctccttggttagatgtatttttaagtatattttgtttgtgtgtgtggtataaatgtgattgtgttcttgatttgactcttagcctgaatttttattggtgtatagaaatggtattgatttttgtacatggattttgtatcttgaaacattactgaagtcatttttcagttctagcaggctttaggcagtctttaggattttctaggtatagaatcatatcatcaccaaagaacaataccttcaattcttttcctatttggatgccttttatagctttctcttgcttaggtgctcaattaatacattattgaaatagaaagtgctgtcattttaatcatttatatttgaaatataaaattttaaaaatttatatttgaaattttaatcatttatatttgaaacataaaattttaaaattttaaaattttaaaagatttggactatgttaagtccaaattcattgcagaaatgtacttatccatttaataataataatagttatagcaaattgaattttgctatatacagcaattacatacagcaactcttttagtctcagcaatgctattaagtaggtagtgacattgcttcatctacatttcactgaaggagaatgtgaggcatagacctgataagtaatttgcttaactatacatgattctgtaatggttttgcaaagatgatataggttatctggattcagagtgcaagctcttacccaccatcctatgctgactactctttctgggttacaggtagttacaaaatgtaatatagattcactttttttgtaggtatatattaattttaatattattacaggagtataactcaaatatgtaaaaatatttttctggttgtctatcactgcttaaccaactgctctgaaatgaaggtgcttagaacagcaacattttatcatcatctgttttaattctaggttgttggccaggctcaattaggtgtttatggcacagcatttctcagttggttactgtcctaaggtagcttgggctaatcatctgaaggttaatcactcacatatctggtgattagtattaaaagtctcaagctactgcagtgctgggccaattgtgacttattaggcatacatatgtatttctacaccaaatggtatatttctcctggggactgtggatatagcacagggctccaaagcgagtggagagacagagaaaaaggaaaaaagaatgacagaaacacagagaaaaggacagaaggacagacagagaaaatgtattaacaatttttttgagctttggaagttaagctcctcacttccactatattctcttttttgagacagccacaaaatttgctaaatttcacaggaagggtatatgacttgatgagaggattgccaatgcatttgtaatcacatctcaaaattactgcaaatataaccttaaaaattagaagaaatcactaaactactgtagaattcataaaatgttgacataagacattaaaattttaaaaatttgtttgctaaaattttagccataattaaaaattttaattaacattctaatatatttattaataaatatttaaaatatcaagtaggtgtccaaaaacaggctgtaaatttatcagatagagagcaccggattgctggtcaatttaagttttctaaatggcactaatggattgataatattatattaaaacccaagaacatgctatctcaaatcaatgtttatttcactaattaatttttaaaactatataattaatatataaaaacaaatttgtgaaaggttagtgaatgaagtatatagaatcaaaattaaaagtagaatcctctatgtttatacagatttacagattcttaattttatttcaaagaagaatatcatacttttttttctggaactttttttcatttagcaatgtgatgtggagagcattccatgatattgtctgtaatatgcctgttctctgtaattgctgcataccttctactttttgtggtaggtatgtatgttcattgactgatagccaggcaagtgatggagggaacatcctgtacatacatgcactcaggtgcaagtatatctggatggcagatgactagatgtagaattgcagagtcaaactgtatgtttaattttttttgtaagagttgtttcactttatactctctcacaaactcttttctcagattcttatgtttgatcaatctcctgtgggaaaataattcgttgactttttatggctacatagtaatccatggtgtatacatactgcactttccttattcagtctaccattgatggacatttaggttgatttcatgtctttgctattgtgaatagtgttgcaatcaacatatacatgcatgtgtctttataatagaatgattatattcctttgggtatatacccagcaatggcattgctgggtcaaatggtatttctgtcattaggtcttggaacagacaaccaaatgctgcatgttctcacttacaagtggaagctaaatgatgagaacacatggccacacaggaagctaagtgatgagagcacatggaacacatgaacaacacacactggggcctcttggagggtagaaggtgggaggggggagaggatcaggaaaaataattagtgggtactaggcttaatacctgggtgttgacacatatttacctatgtaacaaacttgcacatgtacccctgagcttaaaataaaagttaaaataaattcattgacttaaggttattgacttactaaattataatgtccaactttctagtacaagtagccatctttttgatgtgattggccatttttacttctgtgaattgtcaattcatatccttcatctattttcatattggtctgtttgtctttttggttggtgatatataatagctctcactatacaagagataccagtcctttatctatgtgttgcaggataagcttgatgtaaattactttaggtttgtatgcatgatttagcaatattatctactatgacactatattcattcaatttttcttaaaaatgtttcatttatctagatacattttataaaaatgttgctgcaatctcttccaataattcccttagcatcaaaattttaatttatttttagaatacattcatgccataggtcatagagtggttattgtgagacttggatgatggtcttcttaccaataaagacacataggtttgtgttaacccatactactttgatcataaagtgtttccttgatgtgtagcttttaagagggccttgagaattcctgagattttattatttgccaatttttggtaatttttgtggtcttttaattgttactgattatgattagttgcaatatgcttacattttaaaaaatcattatcctatttttggtcatgctaaatgacttatgttttcatattagtgttatgggatgaatagagttacaggcttctgaggaaagagagaaacatgagacatccttatataaaatagggttatatagaataattatcatttttaactgtcttctacaaacacattcagtttcacaaacatctgtaaggcagctcaataattctgtgccttgttttggaagaagtgaacacatatatacatgtacatttgtgataatcaaaatcagtaagtccccttaaagtgctggttttatattatcacaacctacaattcagacattttatccaatattaaagtttaaaaatgaccgtgaaagcaaccagttcacactttagaaaagttcatggggaaaagagaattagcttgtgaacaaaggttttcccaaatagttaaattttgtagtatttgtcaggtaggagtcattctatctctaatttgttgttctccaactccaagtctctgagtcccattattttgctcttcaggccctgaatttggcataaagtgtagtagaggcggacagtgtcgtctcctgtgcatcactgttgctttgcgaagaaattctcaatgtggtcagctgctgctgctacagaagtcgattttctttaaacactgccaagaacatctgacttacatagtatattttgatttgatatttattcaaactgagcctgctttttttctttttacaaactctctaaaactgctaaaagtcttcactttataaactatgtaattaccatgatctttatactgttggtaaagcaatggttcactttccccatgtctttcacctcagttcttttctcccctgtgtgaattgtatccattttgttcaaagtgattttactgaataccaggagttatcacctctcaagtgttattggcaatgagattgtttttgccagttatcagtgaattattaaattccaaagtcccttgttgagggtctgctttttagtgccacttgcccaagctgccatagtctatttttctcagaaagcaaagcctgagataagaattagtgtgcaataacttaatttgagaaatgttcttagggtacaggagtaggggacaggaaagggtgaaacaagaagggagaaaagtcagtacaagaatgtgttaccaaactaatcatcaccataactgttgggactaaagctcatgcggacccagtaggaagttgtgtggatgtaaagcgtgatcattaaccatcactttctattgctcacactgccaggttatgcatatgtgagtgagtgctagctgagtttcttcgagggttccatgaagagatgttaaagaagtctggtgcagaaaatgagagacctgtcctatcagaagacgacttcacaaagctccttgacacagcaaaggctagagaaaaaaaaattagctgaaaaaatatggggtgcaacctaatttgatcaaatgtattagagctttcttttttcttttgtttcattttcacagtatattacttttcatatgattaaatactgtaaattttctcaggtttctgataaagttatgcctgtgatacaggagctagaaagaaattatttaggcagatagtgagggtgaaagtccttggtaaggttttgttttaataaaaagcagccccccaaatcatttccttgctaacaaaaagcagccagaaaaatcaagcttcaaacctagataaacaagctaaagcttgcataggtaaatgctggcaactgtgccagtaattcctcaaggatctagaactagaaataccatttgacccagcaatcccattacttggtacacgcccaaaggattctaaatcattctattataaagacacatgcacacgtatgtttattgcagcactattcgcagtagcaaagacttggaaccaacccaaatatccatcaatgttagactggataaagaaaatgtggcacatatacaccatggaatactacacagccataaaaaagataagttcatgtcctttgcagggacatggatgaagctggaaaccatcattttcagcaaactaacacaagaacagaacaccaaacaccacttgttctcactcataagtgggagttgaacagtgagatcacatggacacagggaggggaacatcacacactggggcctgttgaggtgtggtggactaggggagggataggattaggagaaatatctaatggaggtgacgggttgatgggtgcagcaaaccactgtttcacatgtatacccatgtaacaaaactgcagattctgcacatgtaccccagaacttaaagtataattaaaaaaaaaaaagaaagaaaagggatgggataccttgaagccaggtatattcaacatggatattcaacgtggaggtcccctctttccttttctttgtcaaccatatgtgcagtaaagaagcagcaacatggcactggccatgtagagaaaccatttgcttattgaaaattaaggtggggcagacagcttcttcttacactatgtaaatggcacacctggttccaccaatcctttgtgccctatataaatcagacactgtttcctcaagctcatctataaatccctgtgcatttcaccatgggactagaagatccattcgggagcacctttctgcagaaatgagagctattctcctttctctttctttcccctattaaacctccattcttaaactcacttctcgtgtgtccatgttttcagtttccctggagtgagatgatgagttttgagtatttaccccagacaatgatgctgcttaacctgttacttttatttattcttatttttaaaatttttatttattttttatttattttactttaagttctgtgatacatttacagaacgtgcaggtttgtggcataggtattcatgtgccattgtgatttgctgcacccatcgacctatcatctaggttttaagccctgcatgcattaggtatttgtcctaatgctttctgtccccttgtcccagaccccctgacaggccctgatatgtgattttcccctctctgtgtctatgtgttctcattgttcaactcccactaatgagcgagaacatgtagtgtttggttttctgttcctatgttagtttgctgagaatgatggtttctatccatatccctgcaaaggacatgaactcattttttatggctgcatagtattccatggtgtatatgtacacattttatttattcggcctatcattggtaggcatttgggttgtttccaagtctttgctattgtaaatagggctgcaataaacatacatgtgcatgtgtctttatattacaatgatttttaatcctttgggtatatatccagtaatgggattgctgggtcaaatggtatttctgcttctagatccttgagcaattgccaaaatgtcttccacaatggttgaactaatttgcactgccatcaacagtgtaaaagtgttcctatttctccaaatcctctccagcatctgttgtttcttgactttttaatgattgtcattctaattggcatgagaaggtatctcattgtggatttaatttgtatttctctaatgaccagtgatgatgagctttttttcatatgtttgttggccacgtaaatgtattcttttgagaagagtctgtttatagcctttgcccactttttgatggtgttgtttttgtcttatatatttaagttccttgtagattctagatattagacctttgtcagagggatagattgcaaaaaattcctccattctgtaggttgcctgttccctctgatgatagtttattttgctgtgcagaagctctttagtttaattagatctcatttgtcaattttggcttttgctgcaattgcttttggtgttttagtcctgaagtcttcgcctatccctatgtcttggtattgcctaggttttcttctagggttcttatggttttgggttttacatgtaagtctttaatccatcttgagttaatttttgtataaggtgtaagaaaggggatcagtttctgttttctgcatatagctagcaagttttcccagttttcccgttgcttgtttttgtcagttttgtcaaagatcagattgttgtagatgtgtggtgttatttctgaagcctctgttctgttccattggtctatatatctgtcttggtaccagtaccatgctgtttttgttactgtagctttgtagtacagtttgaagtcaggtagagtgatgcctccagccgcttttttttgttttgttttgttttgttttgcttggggttgccttggctatacaagctcttttttccttccatataaaatgtaaagtagtttttctagttgtgagaagaaagtcaatggtagcttgatttgaatagcattgaatctataaattacgttaagcaccgtggccattttcatgatattgattcttcctagctgtgagtatggaatattttttcatttgtttgtgtcctctcttatttccttgggcagtggtttatagttctccttgaagaaatccttcacgtctctttttagccatattcctaggtactttattctctttgtagtgcttgtgaatggaagttcaatcatgatttggctctcagtttgtctattatcagtgtataggaatacttgtgatttttgcccattgattttgtatttggagactttgctgaagttgcttatcagcttatgaaatttttgggctgagatgatggggttttccaaatatagaatcatgtcatttgcaaacagagacaacttgacgtcctctctttctatttccataccctttatttctttctcttgctgattgccctggctagaacttccaatacaatgttgaaaaggagtagtgagagagggcatccttgtcttgtgccggttttgaaagggaatgcttccagcttttttgcattcagtatgatatgggctatggatttgtcataaattgctcttattattttgagatatgttccatcaatacctagtgaattgggagtttttagcatgaaggtgtgttgaatttatcgaaggccttttctgcatctattgagataatcatgtggtatttgtgattggttctttttatgtgatggattatgttcattgagttctgtatgttgagccaggcttgcatcacggggatgaagctgacttgattgtggtggataagatttttgatgtgttgttagattcggtttgccagtattttattgaagatttttggatcaatgtccatcagggatattggcctgaaattttcttttttgttgtgtctctgccaggctttggtatcagcatgatgctggcctcataaaatgagttagggagaattccctctttttctgttgtttggaatagtttcagaaggaatggtaccagctcctctttgtacctctggtagaattcagctgtgaatccatctggtcctggactttttttggttggtaagctattgattattgccacaatttcagatcctgttattggtctattaagagattcaacttcttcctggtttaatcttgggagagtgtatgtgttgaggaattcatccatttcatctagattttctagattatttacatagacatgtttatagtattctctgatggtagtttgtatttctgtgggattggtggtgatatcctctttctcattttttatttcatctatttgattcttctctcttttcttctttattagtcttgttagccgtcgatcaattttgttgatcttttcaaaaaaacagctcctggattcattaattttttgaagggctttttgtgtctctatttcgttcagttctgctctgatcgtagttatttcttgccttctgttagcttttgaatgtgtttgctcttgcttttctagttcttttagttgttatgttagggtgtcaattttagatctttcctgctttctcttgtgggcatttagtgctataaatttccctctacacactgctttgaatgtgtcccagagattcttgtatgttgtgtctttgttctcattggtttcaaagaacatcttgatttctgccttcatttcattatttacccagtagtcattcaggagcaggttgtttagtttacatgtagttgagtggttttgagtgagtttcttaatcctgagttctagtttgattgcactgtggtctgagagactgtttattataatttctgttcttttacatttgctgaggagagctttacttccaagtatgtggtcaattttgtaataggtgtggtgtggtgctgaaaagaatgtatattctgttgatttggggtggagagttctgtagatgtctattacgtccgcttggtgcagagctgagttcaattcctggatatccttgttaactttctgtctcgttgatctgtctaatgttgacagtggtgtgttaacgtctcccattattattgtgtgggagtctaagtctctttgtaggtctctaaggacttgctttgtgaatctgggtgctcttgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggcagatcttcctccatccttttattttgagcctatgtgtgtctctgcatgtgagatgggtttcctgaatacagaacactgatgggtcttgactctttatccaatttgccagtctgtgtcttttaattggagtatttagtccatttacatttaaagttaatattgttatgtgtgaatttgatcctgtcattatgatattagctggttactttgctcattatttgatgcagtttcttcctagtcttgatgggctttacattttggcatgattttggagtggctggtaccagttgttcctttccatgtttagtgcttccttcaggagctcttttagggcaggcctggtgatgacaaaatctctgagcatttgcttgtctgtaaaggattttttttctccttcacttatgaagcttagtttggctggatatgaaattctgggttgaaaattcttttctttaagaatgttgaatattggcccccactctcttctggcttgtagagtttctgctgagagagctgctgttagtctgatgggcttctctttgtgggtaacccgacctttctctctggctgcccttaacatcttttccttcatttcaactttggtgaatctgataattatgtgtcttggaggtgctcttctcgaggagtatctttgtggcattcgctgtatttcctgaatctgaatgttggcctgccttgctaggttggggaagttctcctggataatatcctgcagagtgttttccaacttggttccattctccctgtcactttcaggtacactaatcagacgtagatttggtcttttcacatagtcccatatttcttggaggctttgttcatttccttttatacttttttctctaaacttcccttctcacttcgtttcattcatttgaccttccatcactgataccctttcttccagttgatcacatcggctcctgaggcttctgcattcttcacgtagttctcgagccttggctttcagctccatcagctcctttaagcacttctctgtattggttattctagttacacattcgtctaaatttttttcaaagttttcaacttctttgcctttggtttgaatttcctcttgtagcttggagtagtttgatcgtctgaagccttcttctctcaactcatcaaagtcattctccgtccagctttgttccattgctggtgaggaactgtgttcctttggaggagaagaggtgctctgctttttagagtttccagtttttctgctctgttttccccccatctttgtggttttaactacttttggtctttgatgatggtgatgtacagatgggtttttggtgtggatgtcctttctgtttgttagttttccttctaacagacaggactctctgctgcaggtctgttggaatttgctagaggtccactccagaccctgtttgcctgggtatcagcagtggtggctgcagaacagcagattttcgtgaaccgcgaatgctgctgtctgatcgttcctctggaagttttgtctcagaggagttcccggccttgtgaggtgtcagttctcccctactggggggtgcctcccagttaggctgctcaggggtcaggggtcagggacccacttgaggaggcagtctgcccattctcagatctccagctgcgtgctgggagaaccacttctctcttcaaagctgtcagacagggacatttaagtctgcagaggttactgctgtctctttgtttgtctgtgtcctgcccccagaggtggggccttcagaggcaggtaggccttcttgagctctggtgggctccacccagttcgagcttcctggctgctttgtttacctaagcaagcctgggcaatggcaagtgcccctcccccagccttgttgccatcttgcagtttgatctcagagtgctgtgctagcaatcagtgagactctgtgggtgtaggaccctccaagccaggtgcgggatataatctcctggtgcaccgttttttaagcccattggaaaagtgcagtattcaggtgggagtgacccaattttccaggtgccatctgtcacccctttctttgactaggaaagggaactccctgaccccttgcacttcctcagtgaggcaatgccttgccctgcttcagcttacacacagtgtgctgcacccactgtcctgtgcccactgtctgtcactccttagtgagatgaacccggtacctcagatggaaatgcagaaatcacccgtcttctgtgtcactcacgctgggagctgtagactggagctgttcctatttggtcatcttggctcctcctcctaattcttgaagatttcattggctaaagtaaaacaaaaattctgctcaaaatgaagccaaaatattttgagtatttgcaaaacaatgttgatactatgagtggagttcttaatgttgttgtgttcaaatacaatgtgtgaaacataatgaagctcagtaactttcgtgtgtaacttttggattagaataataaatatcaatataagcccataaggttttatattatttttatttttcttttcttttttttttatggcttggatgacactttattttcagatccaatactagaagttgtttccatgttcacattttccttcctggtttaaaaaaaagagttgtatttttttttttttgctttttttaaattatactttaagttttagggtacatgtgcacaacgtgcaggttagctacatatgtatacatgtgccatgttggcgtgctgcatccagtaactcgtcatttaacattaggtatatctccaaatgctatccttccccccattgtatttttcatagcttaaaaatcattgacatagaataattccagctaaagtacgtattaaatccctggaaaataaattttgtcttaacaaggtaagttgtgaaaagatgttttgtcacaggaaaaaggaaatcctccatttaaaaccctccatgctgaaataaaggaggagtcccatctttcagtcattccacttcaggcttttgatataactaatctcttttcttcttctttccttttttggcaagctttcggaaacaaaacaggcaaaattttgtgatgataaatatcacagttgccacgcaggccagcaggaatgctatcacatccaaagagtggtactggatccaggtgaggttgtgagctgcgactcgaaggtgcttggctcctttgtggcgcatgacaaactcaatccagaagactgctcgatccaggggcttcattggttggtcatgatgaattcttgataatttcatgacattctctttatagctgaaggataaatataaagatatcaacattaaaagtaaatttattgcttaagcatatcaagtctatggatggtctttgaaaagtgtcacacaaatgattgaaagtaagtgtcactgaattggcatgaaatttcaatgttttaattcatgtcattacagaaagtttggtttttaaattggagttttatcactgacaaatacctttaaaaatgaaaaatggaattttcggtgggaaagttaatgttttctggagcagaaaatattatgagccattctaagtgctataagtaagatagtggaaatggaatttgagaatgatctttttgatctttttaatttttttttattttttgagacaggcttttgctccattacacaggctgagtgcagtcacatgatcatggctcagttcagcctttctctttcggtctcaagtaatcctacatctcagtctcatgagaagctaggactacaactgcacaccaccatgcctggctatatttttttattttttacacttttagatatgaggtgttgctgtagtgcccatactggtctggaactcctgtagtcaagtcattctcctgcctctgcctcccaaagtgttggccctacagacatgaaccactgtgcccagcccattttgacgtatttaaagaagaattgtgacacaactggtgaaatgcctcctaactagtttctcagcttctactctaatcttttgtcttctaccatattttccttctagtagccagaatattttccaaattaatatcaaattatgacactcacctgttaagatttccatctggtttcttgttacattaagaataaattccaaatctgtctttggtctagagaactctacacaggcacctacttgtcctagccctttccccctgtacactttcttctagagacaatggccttcggtttttctctaaactcctgaaggtgttctcaccttagcccctttacaccttttgttccccgtgtctctctcattgagcattctttcttgcaactacttgaggtttgcttctatttctttttgaggcttccccttgtatgatacctcttggagagtcttttcctggccacactataggcacccataggatttctctagtgcttcatgcttactttgctatttgatttctggaactttaaaatatgttgtatatcttctacagtaaaacttcaagtatgaaatacataggataaatgtatatatactatgtgactacctcaaaattttaagattatcttaaacattatcccaaagtgaagacaccaatttatcacaaactgcatagaagaactctctcctcctgggccattttagtcactatttttatcctcaaagtaagtattaacctgatttctgatatcatagattagtattgtttatataattgaattaaataatacatattcatttctgtttttggttagcagttgtttaatagcattggtgtagagagtattcagttgattgacaaagaccacagatgatctcttcattttgtgattaatggatatttgtgttgttaacattttttgaccttactaataattatggtattaagatatttgtatattttattaggtttaaatatttattcatttttgttggatgtatacttggaagaatagttgatgagagaaaggcacatttataattagaattttttgttgactgaattttttaaaaaatattttttattttaaagaatcagattgttttcagttatcgtttttggatgatttataatttatttctagtatgactagaacatataatttttatgaatttgaatcttatacaatttacttagtgtttatttatggcccagcatatggtaaattcaggtaactatttcatataatctttttttttttttgagacagagtctctctgtcacccaggcttgagtgcaatggagtgatcttggctgactgcaatttgcatctcctgggttcaagtgattctcatgcctcaatctcccaagtatctgggactacaggtgctcatcccctacatctggctaagttttgtattattagtggacacaggatttcaccatgttggccaggctggtctcttaactcctgacctcatgtgatcctcccactttggcttcccaaagtgtcgggattacaggtgtgagccaccacacccggtctccataaactcttttaaaaatgtttattttctgtctacacacacacaaccagagatatatgtatggatacatatatacagataaatgtgcaatatatatacacacacacatatataacacatagattacatttaattgtgtacttcaaatgttttatctccttaaataaaatatttcaaagatcactattttgtcttttctttttggtctgcttaaatttaatgtgagtactggtaggttcacttttttgtttttttgcttttttgtttttttttgagatggagtctcgctctgtcaccaggagttcagtggcactatctcggctcactgcaacctccgtctcccgggttcaagtgattctcctgcctcaacctcctgagtagctgggactataggtgcacaccaccatgcccagataatttttgtatttttagtagagacagggtttcactatgttggccaggagtatggtctcgatatcttgacctcgtgatctgccctcctcagcctcccaaagtgctgggattacgggcgtgagtcactgcacctggtcagttcaaatttttttaaaaagttttatttttactttaagttccagtatacatgtgcagaatgtgcaggtttgttacatacgtatatacgtgccatggtggtttgcagcaccgatcaacctgtcatctagattttaagcccctcatgtattagctatttgtcctgatactctcactccccttccatcccccggtgtgtgttgttcccctccctgagtccatgtattctcattgttcaactccctcttataagtgagaacatgtggtgtttggttttctgttcctgtgttagttgctgcggataatggctttgcatttcatccgtgtccctgcaacagacatgatctcattcctttttatggtgcatagtattccatagtgtacatgtatcatattttctttatccagtctatcactgatgagcatttgggttggttccatatctttgatattgtagatagcgctgcaatagacatacatgtgcatgtgtctttatagtagaatgatttatatgcctttgggtatatacgaagtaatgagattgctaggtcaaatggtgtttctggttctaggtctttgaggaatcaccacactgttttccatgatggttgaactaacttacattcccgtcaaaaatgtaaaaagctttcctatttctccccagcttcaccaggatctgttgttttttgactttttaatcatcgccattctgactggcatgagattgtatctcattgtggttttgatttgcatttctctaatgatcagtgatattgagcttttttcataagtgtgttggctgcataaatgtctttttttaagaagtgtctgtttatatcttttgcccactttttgatggtgttgttttttttttttttttgtaaatttgtttaactttcttgtagattccggatattagacctttgtcagagggatagattgcaaaaatcttccctcattctgtaggttgcctgttccctctgacgatagtttattttgctgtgcagaagctctttagtttgatttgaccccatttgtcaattttggcttttgttgcaattgcttttggtgtttgtgtcatgaaatttttgcccatgcctatgtcctgaatgatattgcctaggttttctcctagagtttttatggttttgggttttacatttaagtctttaatccatcttgagttaatttttgtataaggtgtaaggcaggggactagtttccgttttctgcgtatggctagccggtttctccagcaccatttatttaatagggaatcctttccccattgcttgtttttgtctggtttgtcaaagatcagatggttgtagatgtgtggtgtttttctgaggcctctgttctgttccactggtctatatgtctgtctttgttccagtactatgctggtttggttactgtaaggtgtaaggaaggaatccagtggcagttttctccatatggctagccagtttttccaaaacatttcttaaataaggaatcctttccccagttgcttgtttttgtcaggtttgttaacaatcagagggttgtagatgtgtagtgttatttctgaggcctatgttctgttccattggtctatatatctgtttggtaccagtaccattctgttttggttatgtagccttgtagtacagtttgaagtcaggtagcatgatgcctccagctttgttctttttgcttaggattgccttggttatatgggctcttttttgtttccatatgaaatttaaagtagtttttttctaattctgtgaggaatgtcaatggtagtttgatgggaatagctttgaatatataaaatactttgggcagcatggccatttttacaatattgattctttttatccatgaggatggaatgtttttccatttgtttgtgtcctgtcttaattccttcagcagtggtttctagtcctccctgaagaggtccttcacatcccttgttaggcatatgcctaggtattttattctctttgttgcaattgtgaatgggaatttattcatgatttggctctctgtcaaatcatgtactgtcagtgtatagtaatgcttgtgatttttgcatattgatttttgtatccagaggctttgctgaagttgcttatcagcttaaggaattttggagctgcgacaaaggggttttctaactatagaattatgtcatctgcaaacagagacaatttaacttcttcccttcctatttgaataccctttatttctttctctagttcacatttaaatccagcatcttattctatatatatatatattttaattttctaacctgttttatgtttctttactttcttactttttttgaagtatcttaaatcatttcttgtcttactaattttttggtaaagtgtttttaatgtattcccttagctggtaccacctaacctcataataatattggtaggagtaatagactctgaattgatggtagctggtctaggcacagcatttttcatagtatttcctttggattatggaaaagttaagtattacatatttattttatcaacattgaaacctttgtatttcaaaaggcatcttccaaaaagtaaaaaaaaaaatctatctgtccatagtggaagaaaatatttgaaaatcacatatttgataagggattgtatctataatatataaataattcttatgaatccataagataaatagaaaaagacaaaatattcacaagattaaaatagaaatttatctaaggaagatgtgtgaatgaccagtaagcacatgaaaagagggttaacatcttcagccataaggaaatgcaaatgaaaaccataatgagagaccactttacacacactagaatggctgtaatagaaagacaggtgataacaagtgttgggaagagtgtgaagaaattagagccctcctatccagctggtggtaatgaaaaatgatgcaaatactttgaaaaacagtttagcagttcttcataaacaacaatttcccatatgtctcagcaagtccactcctagcatctcctcaaaagaagtaaaaacatatttttacacggaaaatatgtataacaatgttcataaatgccaaaattggaaagacctaaaatgtccatgacctgataaatgggtaattttggtataaacatatcaaagaatattatatagaaataaaaatgaatgagttctgatacatcctacaacataaataaaactaaaactaattatgctaagtgaaagaagtcatttatgaaacaccataaattgtatgatttcatttatataaaatatgtgaagagaataatctattgagaaacaaagtaagatggtatttttctaggactagaggtttattgggagtgacttcatacattatgagtttaatttgaattcattaaaatgttctttagggctgtggctttgtaactatgtaaacatactaaatatatttagattttaaattttagtgaatgttatgctatgcaaattataattcattatcacatttcttaaaataatgataataaaaataaatttttgagaaagaatagattcatactttcagaaattttaggtattgaattgaaatatcatatttctctagttatgttctttcttttcattgtgcattctatcattaaaaatatttaaaataattatctacatatctttaatttttttgattttataattcattgcagtcattggtgacccattaaatctgtggggttgaaatgtaactttgaaataaactgtctggtggaaagtaaggacagattttacattggttaaatcacttcaatcccttcaaaattagtctcttaaaaacgggttaaaattcatattcactgttgacaaaataatttataaataccacctggtcacaaaactgtaatactcacacagggtcattaatgactgacttcaatgcattgagcaaatctctacttgacatggtcctgatgtccacactgagggctgctcccttggctttcatgtgagcaatgttatcatgttgatccgcaaacaagggaatgcccaccatagggatcccatggtagatcgcctcatagatgccattggttccaccatgagttataaaagctttggttttgggatgacctaaaagtggatgcattttaacaaaattattaattacaaggtatgagaattgaataagaaatgcacaatataaggaacttaaagcaaaactgttccctaggtaacattatacccacaaaactgcattgaaattgttttcaaatttcagaagaattgccaggtgaacaaaatgaaaaagcatattcttaattaaaaaattaaaatgtgcaaaaaaaagaataagattgggtatacaagaacgtggtcttttaagtattataaataatgaggtcacatttacatatttaaaaaatatttaaatacttaaaatatttaaaatatttaattttttttaaaaggcagcagggagtagggtggaggtggggctgaggaaggaccagttatgcatcatcatgaaatgtgttatcattttatcatgataaagattggttatttattcccataaaaagtagagtcactggtaatagaaaagtgtccgctatttttcagtgcctgttgaaataaccctgcagtaggggaaagaacagaggtaaagctgcataaataggagacagacagaaaatccaggatgttatttaaaacctgtgagaggaaattacacctgaacaaagagatttttattctgaccataaagaatgtgactgtatgtaataaaatgccaactactatagtgcattctttttatactaagactggaaaataaatataaagtagttaaatttgatttgttttttagttttccaataataaatgctaaatatgtttgttttatgttgaactattatcactccaatttgctgttactaatatattcactgtttgttctccagaatcttaccaagaaggtcattctggggtaaccacttgtacagtcgagtattggaacctaaagtatttggcttcttgccatcaaatctccatagaacctgttagggcaaggaaaatatcttgttcaatgaatagaactctaaaaacatagcatgttagaattctgaagagattaataatcagttagttaatccatataaaagatgaagaaataagaagaagtgatgtcaagtaatgagaactactaaaagtttgaggtaagttgaatacccacgtttaatgtcgttacttttataatcaattttgtatataaagaaataatgacatttctaacataatagctagacacatgagattgtgaaaggaaaataaatcttggcaacccaaactctatgctaaagggaaaagttaagctgcttagggcaaacctacctcccattctattcaaagtcagcccttgactcactgagataaatgaatatcaaattgcctcatttcgagaggctaatcagaaactcaaaggaattcagctatttgtctctcatctacctatgacctggaagccccttccatgcttcaagttgctctgcctttgtttctagctgtcccccatttctggaccgaacaaatgttcatcttatatatgttgattgatgtctcatgtatccctaaaatgtataaaaccaaactgtccccccaccaccttggacacatgtcatcaggacctcctgaggctgtgtcatgggtgcacattttcaaccttggcaaaataaactttctaaattatctgagaactgtctcatatattcagggttcatattttggtaaccatgaagagattctgagtggaggttccctgacctttgataaatgtcctatcagtgcttggtaccagcatgagctaaatttatggctcaaacaaagaagacaattggctgaggtctgggagcaacccctccagagaatctctgataccccaaaattcagacaagatctgaagtttattttgctgtacaactcctttttgttttttttggagttttacttgcttcctacaagaaaggcaagatttcctgtttccatgacaatggaaggcaggtaactctatggagtttgagctcgctcccaggagggaggatgaatttgaggtttctttcctgattctaggatggcagagggcagttttggcctgaaacccatccgtaggtaaacagctgaattgcggttttgtcttggttaatgtttaacaactagctggacttaatttctccttaccattacagtgcttagtgatcacatttctgggattttttttttttttgtacattccagtatttctcccatcagatttgatgaactttacctgacttgatcaaatctgagtgagaattccaaattgtgggtaacaaagcctgtctaatttggctaaaattctttgcagacgcaaaagagaaaacaaaacaaaacaaaacaaaacctaaaaaccatgctcttggtttctgtgtttgcttcctgtctttaaaaaaacaaatgttcttttgtttacttttcctccaccctatacctccttttgccttttgccatttgcagtatgaaaaatctagagaaggcttctaatgacttgaactcttttaaagaattcagaacaaaggcaccactcacccctttaggggtgtctgttttctttgtggagttccaagagttgtgggcagatttttttctcagtccaaagctctgttttcctatgttgaatgacctgatctctttggctttgagattaccacagattaccttgtactgtgagaggattttaccttggcatgtgtaatggcagacgagttacaaagtagggggtggctgagtacagtttactggaagtagtattgactgttgctatttttttcctcctaggaagttgttgtttaagaatcctaattctagtttggagatgtgttgtaaagggtctcctctattgtttttattccccaaattaatctcatttggcttgtctgtgtggatttgtgtgagaaactgaactgtggtttacataggaaaatgagagactgagttttctcagctccaaagtgaaagggcatctgctcctcccaggcaaaaggcacccctaagcaactgggggccttgtgggagtgtcttggggttgaccccctgtgacatggagtggccctgcagggaaatccccaagaaaaattaacttttaaaaaaaggctagtccaggaaacacatatgagggcagatcacccagcattttgagccctctcagaggtcatacacctctggagagagaaactgagacatgtaagagggtggaaacaactcagtggtgacacactgtggagtactgcccacaagcagcacacattgattcaccacacataaaccctaggccacagctcagttcctccttttaggaaaaaaagtgggaaacaaataatctaagaatgatgagaaaacaagaagaatgaccccctgatatcacttggtaggttttatgacacctctacttggcagagtttatgtaaaatgaaggtaatacggtctttgtgcacatatacattaagaaccctaggttgtcctgcaagctatagagttcctaagttctctctttttaaaaaaaattcttttcttcttgctttaaatttgcttttatttttctattaagataaaaaccacactatggattcaacaggtttttgtctgcaagctggtcaattttttttatctcatggctaaagttctgaagtaaaagccatagaatcttttgtgtgtgtgtacatgtgtttgcatatatttaaaaggccattataatttctataattttatgtttaataggcaattgaatccattttattttccttccagcacaccaaattttttgtctctgtaccttatgatgtaaattttgctatttaattttcacttggtttcttttaatatgcaaatgtaagactatttagcttacaactgcctatggtgatcaagtattcatacagattacctattgaaacaggttatcaagaatttggaagtctaatatggcaaaatgtagttttcataaatctataagatgtacttctattggcatgcttaatgtgtgtatgtatttatgtgttttgtacacaatgttttattactgaaaatatataaaagagctctaattaattggcttaagaaaataaaagtgcttgaattaaatactttgccagaaaaaaaagactagtcaaatgctttttcaagtttatgtaacttcaataaaatcttttataaataagataactttacaattattgctaaagtatgataatattagaaatgtcttaagaatttccagcatatatttttgtttgcatttattaatcaaacaatttcatacttattgttgccaaatactttaaggtgtcaaaatttgacataagggttacaaaactgtaaaccaagcacaaaacagaatgatctttgcttgtgtaattttttaataaataagacattgatattggtttaatgaaaatagccacatcttgaattaagtaagattatcataacttctaaccctgtggccttaagcaatctagtccacaggcagtaaggtttgttttgggaaaaaactgttatcatttttatttcaaagctaaaccataaagggtgtgaaatggcaacactatccttcaactcattttcaactcatataagtttttttcctcaagttctgtttgttgtggcataatgctaacagtgctttctaaaagctattcagctcctcaaggtccagggactatcacagaagaggtgggtgtgtgagattttaagaactgatactgagagataagttagtttatttacaaattaatcattaatgtcaaagacacactaatgcaagaccaacatatgggcccctgtgtcagattaacaaggttttctggaagcataaactgacttcttaataaagattataaaggttatgaaaggctgaggaaagttatatcttatggtcaagattagaattttatagattgttcataaaattttgaaaaacaaagttatttggcttcatgctattttattagggcttattgtttggcaaattgagtctcctctctcaaagaatgaagatttttgcctttttttgaaatccttgagttaccacattagtcaaatgaatgatttatcttacctgtgatattaagtgttttaaacctttgatatttgagaaattttccaaacaaattataaattatgattttttctgacctaagtaatcctttaatttattagtttccctaacatccaaaaatgacataatttggtttattttgtataaaaattatacaggaaacattgtcaaatatgaaatggtgtttggtctttttgagctgtatttatataagtatgttattgttatgtgttccaaaattatgggaaactcctataattctgatatgacttagtgtgtacgttatcagtaacaattatatgtgttaagttattgtgtgccacagaggtaacaaatttccttgtccattgtgtctttgactgagtctgccctaaaactttttgtcctccacagacaattgttgtcttactttggtcctctttagaaggcgattttatactcagccataaaattctaacaggtgctcttgaaaaaaagtttttgataattttggagattgtgacattagaatggaagaaaaactttcaggactcatggagaactaaaatgttcatgagtatcaagcagaacaggaattaactacatggactgaaataataaaaaactaaagtaatcttttagactttgcttaaaacattgctgatcctttgttttgtttttttttcagagtgaaggaatctttttttttttgagctattaacagcttttaacaatttagtatactcctatgaaaaaaatttagaacatatttgtttccctctacctgatttttcagaatttggaaactatttgtgagtattttttacttttgtcaatacagttatttgcataagtgcaataagaatctattttcatttttaacaaaacacaattggagaaactggttattttatcaaggcttccactggtatggtgggctttcctttagggaatcaaacttaacttatggagccaataaaaccccttgggaaaactggcctcataccttcatctataaggtccctgtacagggttcctgaactgtgttaagcaaagaatgtaactttctgacaggcccaggaaccccaagtttattttggaaccccaagaggagaggaattcacccaactcgtaggtatttgatggtagaaatctatggctttcctcagctttaaaaaagtcctatctgagattctttctataagacaaagttccatcaaagccactttaaaagcctatgtaaataaaaaattattcttcctcctctgtatacaataatcaggccaagtataataaagcaaatcagttgtaccatggtttgtctttagtaaaattgggaaactgaagacagaaaaattatgtttcaaaaataacagtatacctgttgttagattctagtcttgcctaatgtttttcaacttttattactgtctacagtttggactgaattctaatttttcatggctacacgtcttcaaaatagtgtcttcaggttttttttcctccctttccaccatttttcctagtttggagtcactgtaaactaagtcatgctttcataaagccctacaaattaagctagacaacttaaacttcagaagaaaataacagcagccaatttacatacataatccactttcttacctgcctactgatttatggacttcagagtaatgggcctatattaattttcaaggatttttcttttgtttggttttgtttttctccctttctccctttattttgtcttcataggacatgagacttcacaacctactaaaaatgaactttcctaataactcaggacctgcttaggaataaaccttccttgccattagagatcagatgaaaacctgagaccagagactcattttcttctaaaatgctttctccaaaagattttttttaaatgtaaaaggaaaataagcctgggggccccaaagtcactaagcaaatcactgcctcccattctattcaaagtcacccctctgctcactgggataaatgcatatctgattgcctccttggagaggctaatcagaaagtcaaaggaatgcctcctccctgcttcaagttggcaaaaataaactttctaaatgtactgagacctgtatcagatatttggggttcacaagattatcaatgaaatattcaaatatttaagaattgttaggcagtcttaattctagtaataaaaaagtagcaaattagtaataacctatatatttattttatatactttatactagctgtaaccttccaaatttaatataaatttattaatttttgagtgatatgagaagagtttacttatatccacttgtctactagtcataagttattttatgaatttgacatcattgattacaaaagactaaatatttaaactgcacatatggtgagaaataatgctacatatgtagtatgtgtaatttcttttcatttgctaactatcaagtgctactttcaggaaaaatttcaagtggcagtgtttgacacaaattcagactattatcagtattgctacttttgtaaatgctaacaatgtaggaaaaaggagcccattgacaattcatgattaacaatacagatgctgaaaatgtagaaaattgtattttgctgcattttgcttaactgatctttcacacttagatgatgcactacctagcattgacagccttgatatatggtcagctatagccagtcattaccatgtctagtaccaaactaaggtactgattttagaattcccaagcaatctttataaactggagtagaatttacaagtgttgaccttgtatttgatatgggagtgttaaagtaactctgtgttttcagcaaaaacttgcatagatcattcagagagggctatgtcagataagaaactaaaacgtaaattgaaaatacacaaagattgtatagattagaaaataagttcctaccatgtttatttatattttctgctccttcctcaatctggagaaggcactaatctgattcttagagcatagtctttgttgggccacatttaataatgcacatagtctaccctaaaagcaggattctatctccatcctttccattacatttttctgcttaagacattagtggcacccaagtcagcagagcagacaagttttttttttttttctctaaatctacttggctaggtgggtacctccagagcagtggctagtcagactaggacattctttctctgaatggcaccctgaacagaacgctaaatagacctattccaatgcatgggaagtaaaaacagccagattgcttggtaagacgaagctgcatgatgcatttcaaagttttttcaatacctgcttattgttattgtgatagtacagtaacttattaaaatttaactgctttttgataatatctacagtgtatacagtaccttctaaaatcctgtaaaccaaaaggagcaaatgacagggcagaatttagtgatttctatgtacatgctacgataccatgataataccaaacttcactagcacctcttaaatatatttccttctgatcacaatattaatgccaacgttattatcaaccaaaactcctctctttatgattttaagatcttccatatatgtttttgctttgaacagatgtctgagataattagaactatcatagcagttaaattttcaggcagaacatttctgtaatggactcttgaagagtttaacagattcatttagtagccatccacagttaaggcactttatctaaccttttgtgggatctgggcaagggctgatgcaatcatgttggcactttcttctgacatgttactgatcatcgaccccagagaaaacaccacaataccattttctccagagctctgcacaaactcttccatttcctgtgaagaaagaatttgttctatcagaaaagagcaacagcacagaaaacactattgacaggattgttacaaacatctaagatgagaaagtcaggagctattggagtaatttttttaaactgacctaatcattcagtttctttgaaaggagatgtgtaatataatatatgtgggatctttcatgcaaatttgtgtaaatatgtgtgcatatgcatgtatgtatgtgtgtgtaaggaggaaatgaaacaaagctatgacactgcagtaggaggagataatgctagaaaatgttacacccagacactttatttataatattataattactaacataggttattggaaggtagctttacttggcttcaattctaattttttttgtggttctactaaatctcttgtgtttatttggagtagttttattttattttatttttttctgttcagttcttttagttaggagtcattggagccattacatgactatgagcaatgaggaaaagttagttacaattggaatgatattatatctacatttatttagcttctagctctctaaccctttatatttcacttaaagttagggtttcctagtcttaccccactacccctcactgcccccgacacccccaccccccaaaaacaccttaaaagctgaagtataagaatcactgacattcagcagtctggtattgtggtttggaatttctgggaaatagttctgagaattccatttataatacagtattatatactatatagttacataattaagtgatcttatttctcaggtcattgcttaggtatgactatgacaccttttgtcctgaaatcacactgtgaatttgatgtgctatgtataactgaatgtgggggaccctcatcatcactttgctgtgtctcacagggggcacttgaaccacagtgggagaggtcaccaggactttctccagtggagatctgctcaccccctagagtagctccctcacactatatgaagctcctggtgaatatgtgtttgctttgaaatgaatgagaattattctgacttgtgtttcctgatgtgtccctgtttttaaacttaaatccattctctaatgccacatcgctcaatgtattctcacaccaaaaaaaaaaaaaagagagagagaaagaggaaaagaaatgtagacccataagtttcctggatatcatatcaaaattgtatactcatctttttgttgctgttgtcccttttgttctaaattctctttttctcagtaaaataatgaccaaccccttctgtcataacaaatatactttctggtcctaatcattgggggaaatttctttataaaactgtttacaaataaaaaaagaaattctaaaatatgtcaattcagaccatatattggtaagtatttttaaaaaatataatttaactttatgacatcttttttttttttccagatggagtctttctctgtcacccaggctggagtgcaatgatgcaatcttggctcattgcaacctctgcctcccaggttcaagcaattctcctgcctcagtctcctgagtagctgggattacaggcacctgccaccacgcctggctaatttttctgtttttagtagagacaggtttcaccatcttggccagagtggtcttgacctcctgaccttgtgatccacccgcctcagcctcccgatgtgctgggattacaggcatgagccactgtgcctggcctgacatcagttttaattggagattcagtgtatggctattagagataattcatgaggcatccaggaactcagtgtaattgcagttgcctgtagccacatttaatgtaacttgagttcaatgttttgtctcattcactgccaaaagtctgcttcacccacccagtattgaagtaataaaacatctatttatagacagatcagcactgatctcattctgtgatgtctttatgaaagtaatggtaatagaagatcaatgtaagtagttttataaaagtatgaaaatttagaaaaagaaaatcatttacccatatctctatctcaatttaaaatgtgtaccatttcattatgggtttaattctatttatataactcaatgtacatatgtgatgtttatttagaaaattttattctcattgtatatgcctttttattctacaaaaaaactgtgatcttgttctactcatcattttgttccttagtttccaactatacctgtaccacggctgacagtgtaattaaacattgttttgaaaaaaggattgtaatggcttggtatgcacattatgtaagtttttaaccatttcttaatgtaagatatttgaattatttccagagtttttttaatgagtatttgctaccgatattgaatcttaccatcatgatttattctctgtacagtttcatgtgagtatattataaaggcaatgcctatatgcatttttcaaacacttgatactttttggcaagagtcttattcttttgaaatatacaaacattatctgagaatctaatacataatggaaaagcaagcaaatttgtggcaacaattattttgtgtacaaaagaattagagaatcagtttcacaattatttacttggattcaagtctaccttctgcaagttaacaacaacggaggctcacacttgtaatcccagcactttgggaggctgaggcatgtggatcacctgaggtcaggagttcaagaccagcctggccaacatggtgaaactctgtctctactaaaaacacaaagattagtcagatgtgttggcaggtgcctgtaatcccagctactcgggaggctgaggcaggagaatcagatcgcttgaacctggggggtggaggtttcagtgagccgagatcatgctagtatcagtaataatcactattgtactactagtcatttatcccttgtccttattctgctactctcttccccctgctactggcactatcactttcttttaatgtgagtgaggaatttttttttgagaataagataagagtacacagaattaccttttaagctagaatattaatgaagagcctccacctttacaatacaactttagctttccagcttgttcaactgactgcccaaacttaaacatttacatttaaacaagtacacagagtatctgttctctaggactttgctagagaatataatcttgatgtgttggaaaatcaatcactattaaatgaagactgatatcttaaatggctggcacatgttagctaatttaaagtattaaaaataatgactaaaataatcataatatcaacaatatttttggatcactggctgtgtgtcagagacaacttaagtgttttatctgtggtaactactttttttccacacagcacaatatgaagttgtgattattattataaaagtagtcatgattgcttaaactcatgtaaaagttcctaaatgatctttacattttacaaacttgcctttttgcaatattatacattgggaatattgggattttttaaaaggaaatctgatcatatctcttcatttcttaactcttttcactcttttcagtagctctccattgtccctatgggtatatcaaattacatatatatatatatatattttttttttttttgagacagattctcactctgttgcccaggctggagtgcaatagcgtgatctcggctctctgcaacctctgcctccggggttcaagtgattctcctgcctcagcttcccaagtagctgctattacagtcacctgccaacatgcctggctaacttttgcatttttagtagagacggggtttcaccatgctggccactctggtctccaactcctgacctcaggtgatccacctgccttggcctcccaaagtgctgggattacaggtgtaagccaccacgcccggcccatcattgacttttactcaaccttttcctgtaaattaaatttggagttcctgggaactgcccttattgcttttctacttttctgccttaatgcaagcctttactttttttttttttgtttatttgtttgtttttgagacagagtctcgctctgtcgcacaggctagagttcagtggtgtggtctcagctcactgcagcctctgctcccagactcaagcaagcctcctgcctcagcctcttaagtagctacgactatgagactacaggcacacaccagcatgcctggctattattttattttttatttttgttagagatgaggttttaccacgtttcccaggctggtctcaaactcctgagcccaagcaatcatgccttctctgcctcccaaagtgcagggattataggtgtgagccaccttgcctggcctctggttttctttttgggtgtttctcatcccctcatcgtttcacctatctctgcacattattgagtactcactttaattgtcaatgagtttgggatctcttctgcatatttctttatcattgtggtctttccttataacactttttagacttttctttttcattgtttttattctatctttcaaagtacaatgtaaggcatgagggagcagaaactgtgctacctttattctctgaaaatccagcacttacctgtggtttgtattaatcactctacaaatattttttgaagaaatgaatcatactatcttttgggtggcacaatgaaggccttactttaaccaaccctgttttcaaaatctccctagtaaacctctttggtctttaatgataataacattcacatacttgtgatactacagaaatatatgattttctaatggcaagtccttgtttttgacctcccatattcccctcactctgagttaaacactctgaaagaaacatatccagccattccttctgaaaatgtcaagcaaacaaatgaaacaagaacacatttaccttaggcaggggtttggctggtttacagtgaagtcctccaacaaaatcaacatttggtaagaatgggcgaggaaattcaaaatcccaataggttcgaatgagccacatttcagctttccccattgtctcaaataatgtagtgggtcttcctgatggaaaaaaacaaaacaaaacaaaaggtagctaacacgagaattgttatttgaatatgcaggtattttcctgaaaggacttggaataacatacccaaacatatataaaatgtctgtgcattgataaaatatatataaatacatttatatatagtcataatttagattttatttattgcatatgttgctcatatgtatatataaggaaggcaatgtattcagagatctgtaagaagaaatcacatctttaatgtaacatcagtatattcacaatcataaataattattaaaataagtcactaatatggtttgactgtccccacccaaatctcctctcatcttgaattataatccccataatccccatgtgtccagggagggacccagtggcaggtgattggatcatggtgtggattcctccatgctgttctcatgatattgagtgagctctcatgagatctgatagttttataagtgtctggtatttcccctgcttgcacttctctctcctgccactaagtgagaagatccaagcttgcttccccttagcctttcaccatgattctaagtttcttgaggcatcccagtcatgtagaactgagtctattaaacttcttttctttataaattacccagtctcaggtatttctttacagcagtgtgagaatggactaatgtagccactatgaacttaaatacacatttgtcttccctctgaagctgcaatagtaacaaatatacctttaaacaactctttcagttccacaattaattcatcttaccttacccatgaaaacagctttccaggaagtactctagtgtctacagtttattaagctagtcccttgatccttggttctcaaagtaaaccatgagttttttgagctcaacactgaaatctttacacctactactgtcttggttcatcttaagatcttaatataattagatttttaaaataaatatatttacaaatgagaattaaaacattttcagaatttattgacatagagatatgtgctctcccttaatttggcccctattttctttgatggagagatgcagtttaataaaatatagattaaaacttagatgttcactttcaacaagatttcagtttttgaaagaaataattgtcaacctgttattgaaggaatgtataaacattagaaatctcaagttttaggcttctgtttctggagtagagccactatattactcaactgtgaaggaatccttcttacatgaaaaacaaaatttaatttctaaatgaggaaactgaggaactcaaagagaaacaaattcctcaatcctgcattgataatttttctagaaatatgtgtaaatactaaatttacgtgtctgccttcatgaagatgtttcttgaggtatctattgactttttttaaagatgaaaaaatgtatagcaaaatgatatgtgatagtttaaagaaatcattagtgctttacaatgaaggtttatgactctctgggtgtcctgtagtagtgatggccccagggttctaactgattctataaggtcaacattctataatatttttgagactgatagatcatcttacatttgcaattcataatttcccttaaaaacactatcttctgacattatatttatataagctcaccttcaaaggcacagaaaagttagaacttaataagcaccagttagacacatgacttacctagaacttcactataaaactggtcccacttcttcagatcataaatttgaaaccaaaagtcaaaataaagcatatgtatcatattttttatcctctccatgaaaatcatttgatcacttaattctgacataacaacaggtacataggaaggagggaacagaaatcctccaccattcttctcaaatgtgtagccaacagagaatcgaagactgtacagaaagggtatgttaaatagttcagccagtagctcaccacagggattaagggcatctgccagaatgacatcaaactttgactcttgtagtttcatcataagtttcttattcaaaactgcatctttacagagcttgttactgtagtcataatattcccaacacaattcttgtaattgtgaaaaatatgaccaaaatgtattttttgaaacaccatatatccatctatcgagaattttcagaagagaatcttccaaatcatttttagttaaagatgtaggataaacttctaatttaatagcagatgatttactggcattgacaagagtagaagccgaagatgtcaacacagtcacctcatgacccctctgaacaagctcttccaggattgtcttcatatttatccaatggctgtattctgtgggccacactagcacctttccacagcttccagagctaaagtaacaactgagctgtatcagcagaaagactgacgtccatttcagagacatcctggtcttatgcaatgcttcttttccagttgttgtttctttctgtcatttctcatacttatatctgaggaaaaatcaatcaagttaaaatataactgctaaaatttgaagtaaatacataatactaacagtctgaataggtgcatgccaaggagaccaacaaaagattgatgacctcatatttattttagtgtgtttggtgttcttttatgtttacaattactctagtcaagcaataatttttatgacctagaatatgtaagtaacctgtcttatgtaattattttataatactgttaagaacagtggcaagtgagaggctcctgcctgttcggtgcccttgacatagagagaagaagtaattatacaactcaaacggcattttttaatatcgtggtgcaagtaatgtcttctaaaactttgttgacacataattcatatgccatatgactcaccaattagtgtgtacagttcaatgtttcctagtatattcacagaattttactttcactacaataatcagtattatctccaaaagattctatacaatagcctctaaccccccactctgaaattttgcatccatcctaccctaggcaaccactaatctaatttctatctctatagattagcattttctggaccctttaaaaaataaatgagggttttccagtgatcatggcagatgggatgcaggactagattgcagctccagacagagcagcatgcagaggcttgcattgtgaattttagctgcagatcaactgcaagaacagaccagcaattctgagaggatccacacaccctctgcaggaagcgtactgctcctgcaggacctgggagacatcccaaacactgtgagtgccccaacaatggaagtgggaaagggtgatccccctctccagaatacacatccccactggagaagctgaagttctgttggcaggagaagttcctgactttatgtgaagctgagtcaaattagagaaccaagccaagcaaaatacaggggtagaggaagtagcagaaaggcactgggagctctctggatacccaagcggctcattcctgcctggcatcacagggatctatcaggagggtggccagtgatgcagggggttcaaagattctcctcagggcctgaaggcttgaagggatgagtaactcctcccttctcaggcccagccccaagatgcaagaccacttgcatcagcagcgtgtgtcagcaagatagcagaagcaggaagagagccggccagaagacacttaccctggctggaagagatgtacccctgaagatcaagaaataggccatccaggtactacatagcagtcacaacagactgggacacttactgtttacagaggactacaaaacccctgtcccatcctcactgggggctgatgccattttaggcctcagcccacctgcaaccaggcgttcattaaaacagcatgttgctccacaccgcctcctgttgtctgttggcgcgctgttggggttcaaactgattcaagaaccttacatctggtgccaaatcctaggaggggctcaggtctgtgtcgcttgtggacctacccctccaccccagagagcaggccacagcaattagacagaggaagctcctcagcctccagtcgcctctctgtgcatgcgcatcagccactgatctcgcctactggtaagtttcccttggagcccggttaacagggcaaaatctacatggcctctcttggtttctccagtccaaaaatccaacactgatccaagaaggcgccagcgtgcgccaggcactcgctggtcatctggtcttagggggatgcctctaagccatttcatcccattccaggaaccaaaaaggcagcggagacgataactccttttatcgtctccctccagctgtccaggatggtctcctttttccctgttctctcgagctacccttcattatgggaaactcccggtcctcaattccaaaaaacagccctccagcctgcctcattaaaaatctgcaaaccttaggcctcaggcaagatatctgccataagtgccttgtcttttttatacgataaagcctggtcgcagtatgaattagataacgggtccaaatggcccgcaaatggaacactcagctttacagttttaactgacttaagcagttattgcagatgactgggaaaatggggagaaattccttgtgtccaggcctttttgcactcagatcacagcccgacctctgcaattcttgcttacctgttcaaatccttcttcattctcgccgccctcattgcctttatcctcccgaccctacctctttttcctcattggatggagcagactgctgtccacccctcccagaccctacccctccatctcaaccaacttcattaactccccaagcttcctcattgtcttctcagccaccatcttcccagccaccatcttcccagccagcatcacccacttcttttcctataccatcctctcctcaggaaaactctagcattgcctgtactcattctccttccttacagccctctcacggagcctgtaaacccatcccgccaccttacacccgtatctatcctccaatgcctatcaactcaaccccccttccctcttcaaaccctcagcaggaaccccttctggcttcttccttctctcctgcccatactagctccggcaccatctttggcccccatgccccacccgtactttagcgccagtgctagaatgcccccttcgggaagtagcaggaactgaaggtattgttagagttcatgttcccttctccctcactgatctctctcaaactaacaaaagactcagttcatttccagaagatcctacctcttatattagggagattcagtaccttactcagtcttatgaactaacctggcatgacagctacttatcttctcttccaccctcaccccagaagaccagcaccgtacttggaccctagctcaggtgcatgctaatacaattcatcatcaagctcctgcccagcctactggcacagaggcagttcccaaccaggacccccactgggattatcaagacagggcctctggacacagccatcaagacctcatgattatgtgtctccttgcaggactcaaaaagggtgcccataaagtggtaaactatgaaaaactttcagaaatcaccgaaggtcctgacaaaaacccagccctttttctctcttgtttaactgaagccatgagaaaattaccaacctggacccagccagcccagaaggaaccactatttcaaaccttcagttcctcacccaatctaccatgatatttggcgcaagcttcagaaggttgatgacggccctcaaaccccacagtgggaccttcttaatttagccttcaaagtctttaacagttgtgatgaggaaagtaaaagaaaaaaacagtttccaatgcttgcctttaccctgcaggcccacagggccacagctccatacagaagcctcctagcaaaacacctccacctggcgcctgtttcaagtgtggcaatgaaggctactggtccaggccatgcccaaacccagctgtgctcaccaggctgtgccccctctgtggaggactcagtgaaagtcaggctgtgagcggctccagcaaggatcgcctccatccctttccgagctggccaaaacctcctactcggatctcatcggccttgccactgaagactgacagtgccctggaacagatgtcccagcaactaccattgcttcatctgagccaagggtaactctgatggtggcaggtaggcatgcatgttttttaaaaattaatattggagcaacctactctgctttacctaaattttcaggacccacccagtcctcccaagtctctgttgtgggaatcaatggacaagtctccaaaccccaagacccccctccacttttctgctccctgaacaccttttccttcagtcactctttcttagtcctgccttcatgcccagctccgctcctaggcagagatattctttcaaaactccacactactctccacttccacattccccatagtacccaacacatcaacccagacccctccaaggcttctaacaggcttctaaccttcttctactcctccgacctcccaccctgaaacatgcaacttttccttatcccgcacctgtagttaaccccactgtttgggatacttccacaccctcggtcacagagcaccacacccccatccacatcacccttaaagagcccaccccgttcctatcacagaagcagtatctcatcccccaagcagctctcataggcctaaagcctatcatttctctcctcctcaccagtcacctactctgcccaacaaactctccttttaacacatcagttctacctgttaaaaagccagatggaacttatcacttagtccaggacctcaggctcattaaccaagctgtactcccagtgtgtccagtagtttctaacccatatactttactttcctcacttccctcgaataccacccatttttctgttctaaacctaaatgatgctttttcacaattcctttacaccctgattcccaaaacctctttgcctttacctgggaaaaccccgacacccacctttcaggtcagctcacctggtgcgtactacctcaaggttttagagacagcccccacctttttggacaggcccttgctagtaacttctgtactttatccctaaaatcatcctctcttctttaatatgttaataatctgctcctgtgtagcccgtctcaaagagactgcaacacccatacatactatctcccttttaaacctcttggcagaacaggggtatcaggtctcccctaagaaagcccaaatatgcaccccccagtcacctatctaggcctagctcttacccctgaatgcaagggctcacaacagaccacatactccctccttctgtccctcccgcctccacaaactaagcaagaaattctctcttttccaggattagcaggatattttaagctctgggtttcctccttcgctctacttaccaaaccgttgtaccaagctgctaaaggccctctccatgagcctttaaaacctgcacagcctattacccaacctttccatctactccaaaagtctctcatctcagcccccatcctcactctcccagacttcaccaaacctttctccctctataccgatgaatggcgtggagttgcactaggtgttctaacccagtctaagggacccacccggccaggttgttgcctacctccctaaacagcttgaagccacagttctcggatggcctgcctgcccctgagcattggtggcagttgctgtcctcactcttaaaagcctaaaactatctcttcatgccaacctaacagtttattcaacccataacatcaaagacatgttagctcaccgcagtgtactaagtcttttctctgccccacggctcctccagctgtatgctctattcatagaaactccccacatcaccatgctaaccacctcccatctaaacccggccatgctcttacccgaagctacaaccgcccaagactcttcttcacactcttatgtgtgaatactgttcaaacctttcttataccttttccaaacctaacagaaaaatcccttccagatgcgtcctttactcggtttgtagatggcagctccttcctacatcaaggacaccgacatgctggctatgctatagtgtcaccccccaacactattgaagtcaatctgctcctcttaggcaccacctcccaaaaggctgaactcattgccctcactcgagctctcattctagcatccggaaaacagatcaatatattcaaattctccttatgtgttccacgtagtgcactcacactcatccatctggaaagaacggggtttcctcactgcaaacaatactgtcataagtggctctctcatcagcaagctccttcaagctgccaggctcccacagaaagttgccatcattcattgcaggggccaccaaaccccagacaatcctaaattggctggaaatgtgctagcagatcaggtagccaaacaagtagccctactaccctttcgaggccagttgctgtccttgtccttgttctctcctctttacttctaagaagaaaaagatttccaagcccaaaaccttcaaaagcaaggacgatattatgtcaaggaagggtgcttagttattcctcactctcaaagccttcctcacctccaaagcctccacaactctttccatgttggttaacaacctcttgcagcttctccacgctattctcacttgtcgtcacttttccagccatgttcaagaaattatccagtcctgctctatctgccactcaatgtaaccccagggatccctccagcctctgccttttcatacccaccaagcccagggccaggtacctggggaagattggcaagtagacttcactcatatgctgcatgataaatgtctctgctatcttctaatccttgtctgtactttctctggctagggagaagtgttcccaacaacttcaaaaggtgcaaatatcatcacacaaactcatcatgcatacagttccctgtttcagactcccaacatccatccagtccgataacagtcctgccttcatcagccacattacccgaggcatctctacatccttaagaataagtaagttctccacacaccctacacacctcaatcttcaggcaaagttgaaaaaattaactctgtccttaaagcctaactcatcaagccggctctagaaacctgcgagtcatggacaaaaaaatctcccttttgccctcatgagactttgcacaacaccaaaagcaccctctttttttgtttttgtttttgtttttgttttgttttgttttgtttttattatactttaagttttagggtacatgtgcacaacgtgcaggttagttacatatgcatacatgtgccatgttggtgtgctgcacccattaactcgtcatttaacattaggtatatctcctaatgctattcctcccccctccccccaccccataacagtccccagtgtgtgatgttctccttcctgtgtccatgtgttctcattgttcaattcccacctatgagtgagaacatgtggtgtttggttttttgtccttgtaatactttgctgagaatgatggtttccagcttcatccatgtccctacaaaggacatgaactcatcattttttatggctgcatagtattccatggtgtatatgtgccacattttcttaatccagtctatcattgttggatatttgggttggttccaagtctttgctattgtgaatagtgcagcaataaacatacgtgtgcatgtgtctttatagcagcatgatttatagtcctttgggtatatacccagtaatgggatggctgggtcaagtggtatttctagttctagatccctgaggaatcgccacactgacttccacaatggttgaactagtttacagtcccaccaacagtgtaaaagtgttcctatttctccacatcctccctggcacctgttgtttcctgacttttaatgattgccattctaactggtgtgagatggtatctcattgtggttttgatttgcaattctctgatggccagtgatgatgagcattttttcatgtgtctgttggctgcataaatgtcttcttttgagaagtgtctgttcatatcctttgcccagtttttgatgcggttgtttgtttttttcttgtaaatttgtttgagttcattgtagattctggatattagccctttgtcagatgagtagattgcaaaaatgttctcccattctgtaggttgcctgttcactctgatggtagtttctgttgctgttcagaagctctttagtttaataagatcccatttgccaattttggcttttgttgccgttgcttttggtgttttagacgtgaagtccttgcccatgcctaatgtcctcaaagtattgcctaggttttcttctagggtttctatggttttaggtcaaacatgtaagtctttaatccatcttgaattaatttttgtataaggtgtaaggaagggatccattttcagctttctacatatggctagccagttttcccagcaccatttattaattagggaatcgtttccccatttgtggtttttgttaagtatgtcaaagttcagatggttgtagatatgtggcattatttctgagggctctgttctgttcccttggtctatatctctgttttggtaccagtaccatgctgttttggttactgtagccttgtagtatagtttgaagtcaagtagtgtgatgcctccagctttgttcttttggcttaggattgacttggcaatgtgggctcttttttggttctatatgaactttaaagtagttttttccaattctgtgaagaaagtcattggtagcttgatggggatggcattgaatctataaattaccttgggcagtatggccattttcatgatattgattcttccttcccatgtgcatggaatgttcttctatttgtttgtatcctcttttatttcattgagcagtggtttgttgttctccttgaaaaggtccttcacatcccttgtaatttggattcctagatattttattctctttgaagcaattgtgaatgggagttcattcatgatttggctctatttttgtctgttattggtgtataagaatgcttgtgatttttacacattgattttgtatcctcagactttggtgaagttgcctatcagcttaaggagattttgggctgagatgatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctttcttgtgccaattttcaaagggaattcttccagtttttgcccattcagtatgatattggctctgggttgctcatagatagctcttagtattttgagatacatcccatcaatacctaattcattgagagtttttagcaagaagcgtcgttgaattttgtcaaaggccttttctgcatctattgagataatcatgtggtttttgtcgttggttctgtttacatgctggattaagtttattgatttgcatatgtagaaccagctttgcatcccagggatgaagcccacttgatcatggtggataagctttttgatgtgctgctggattcagtttgccagtattttactgaggatttttccattgatgttcatcagggatattggtctaaattctctttttttttgctgtatctctgcgaggcttcagtattgggatgatgctggcctcataaaatgagctagggaggatttcctctttttctattgattggaatagtttcagaaagaacggtaccagctcctccttgtgcctctggtagaattcggctgtgaatccatctggtcctggactttttttggttggtaagctattaattattgcctcaatttcagagcctgttatcagtctattcagagattcaacttcttcctggtttagtcttgtgagggtgtatgtgttgaggaatttatccatttcttccagattttctagtttatttgcatagaggtgtttacagtattatgtgatggtagtttgtatttctctgggattggtggtgatatccccttaatcattttttattgcatctatttgattcttctctcttttcttctttattagtcttgctaacgatgtattaattttgttgatcctttcaaaaaaccagttcctggatttattgattttttgaaaggtttttgtgtctctatttccttcagttctactctgatcttagttatttcttgctgtctgctagcttttgaatgtgtttgctcttgcttctctagctcttttaattgtaatgttagggtgtcaattttagatctttcctgcttcctcttgtggggatgtagtgctataaatttccctcgacacactgctttgaatgtgtcccagagattctggtatgttgtgtctttgttctcgttggtttcaaagaacatctttatttctgccttcatttcgttatgtacccagtagtcattcaggagcaggttgttcagtttacatgtagttgagtggttttgagtgagtttcttaatcctgagttctagtttgattgcactgtggtctgagagacagtttgttataatttctgttcttttacatttgctgaggagagctttacttccaactatgtagtcaattttggaataggtgtggtgtggcgctgaaaagaatgtatattctgttgatttggggtggagagttctgtaaatgtctatcaggtcaccttggtgcagagctgagttcagttcctggatatccttgttaactttctgccttattgatctgtctaatgttgacagtcaggtgttaaagtctcctattattattgtgtgggagtctaagtctctttgtaggtctctaaggacttgctttatgaatctgggtgcccttgtattgggtgcatatatatttaggatagttagctcttcttgttgaattgatccctttaccattatgtaatggccttctttgtctcttttgatctttgttgttttaaagtctgttttatcagacactaggattccaacccctgcctttttttgttttccatttgctcggtagatcttcctccatccctttattttgagcctatgtgtgtctctgcacgtcagatgggtttcctgaaaacagcacactgatgggtcttgactctttatccaatttgccagtctgtggagtatttagcccatttacatttatttttaaatgtattggagtatttagcccatttacatttaaggttaatattgttatgtgtgaatttgatcctgtcattatgatgttagctggttattttgctcattagttgatgcagtttcttcctagccatgacggtctttacaatttggcatcttttgcagtggctgctactagttgttcctttccatgtttagtgcttccttcaggagctcttttagggcaggcctggtggtgacaaaatctctcagtatttgcttgtctgtaaaggattttatttctccttcacttatgaagcttagtttggcgggatatgaaattctggattgaaaattcttttctttaagaatgttgaatactggcccccactctcttctggcttgtagagtttctgtggagagatctgctgttagtctgatgggcttccctttgtgggtaacccgacctttctctctggctgcccttaacattttttccttcatttcaactttggtgaatctgacaattatgtgtcttggagttgctcttttcgatgagtatctttgtgttgttctctgtatttcccgaatttgaatattggcctgcattgctagattggggaagttctcctggataatatcctgcagagtgttttccaagttacttccattctccccgtcactttcaggttcaccaatcagatgtagatttggtcttttcacagagtcccatatttcttggaggctttgttcatttctttttattattttttctctaaacttctcttctcatttcatttcattcatttgatcttccatcactgataccctttcttccagttgattgaattggctactgatgcttgtgtattcatcaagtagtctcatcctgtggttttcagctccatcaagtcctttaaggacttctctgcactggttgctctagttagccatttgtctaattttttttcaaggtttttaacttctttgccatgggtttgaatttcctcctttagcttggagtagtttgatcatctgaagccttcttctctcaactcatcaaagtcattctccatccagctttgttccatttctggtgaggagctgcattcctttggaggaggagaggtgctctgatttttagaatttccagtttttctactctttttttttccctatctttgtggttttatctacctttggtctttgatgatggtgatgtacagatggggttttggtgtggatgtcctttctgtttgttggttttccttctaacagttaggaccctcagctgcaggtatgttggagtttgctggaggtccgctccagaccctgtttgccttggtatcagcagtggatgctgcagaacagcggatattggtgaacagcaaatgttgctgtctgattgttcctctggaagttttgtctcagaggagtacccggccatgtgaggtgtcagtctgcccctacaggagagtgcctcccatttaggctactcagttgtcagagacccactggaggaggcagtctgtcctttctcagatctgcagctgcatgctgggagaaccaatactctcttcaaggccatcagacagggacacttaagtttgcagaggtttctgcttccttttatttggctatgctttgttcccagaggtggagtctacagaagcaagcaggcatccttgagctgcagttggctccacccagttcgagcttcccagctgctttgtttacctactcaagcctcagcaatgtcgggcacccctcccccagcctcgctgccaccttgcagtttgatctcagactgctgtgctaggtatgagtggggctctgtgggcataggaccctctgagccaggcatgggatataatctcctggtgtgccgttcactaagactgttggaaaagcgcagtattatataaagagtgacctgattttccaggtgccatctgtcaccgctttctttgattagaaaagggaattccctgaccccttgcacttcctgggtgaggcaatgcctcaccctgctttggctcatgctcggtgcactgtacccactgtcctgcacccactgtctgacactccccagtgagatgaacctggtacctcagttggaaatgcagaaatcacccatcttctgtatcactcatgctgagagctgtagactggagctgttcctatttggcctagctaattattaatatttcttttcttatagtaattttggttttggtttgttcttgcttttctagtcatttgagatagatcattacattttttatatgaaacctttctccttttcttgtgtaggcatttcttgttctaaacttgtctcttaatagtgcttctgttgaatctcacagattttgctattgcatgatgtgatctttctttgttttaagcaatttcaaaattgtttcttttttatctattggttataaggaatatgttgttaaattttcatggatttttctagttttgtcttggcattgattttataatttatttcattgtgttcagataaaataatcagtaaaatttttattttttaaaatttgttgagacttgcttaatgtcctcatatatggttaattctggggatgttatatgtgctataaaaagaatcttacattctgcagctgttggttaaaatgttctgtaaatatcaactacttcaatttggtctatggtacagtttaaatctcatgttgatttattgtctaaatatctgtccaatgctgaaaaggtgatggtgacatcctcaactattattggacttaggtctatctctcctttcaggtataataatatttgcttcatatatctcagcggttcatggttggttgcatatatatttacatttttgtctttttgaacaattgattcatttattatcatattaagtctctcttttcctctcaaaattttggcttaaagtttgtgttttgctgaggtaagtgtagctatttctgcttgatttgggtttctgtttgcatagcatatctatttcatcttttcaattgcagtctatgtgtaactttattggtgagatgagtatcttttaggctgaatattgttgagtcttgttttttaatccatcaatctacgttttcagttgtgtaatttaatccacttattttcaaggtatttatttatttataggtaaaggcttattcttttatttttttctgtttattttgtatctcccttattccttaatttctctcttattacttattttgacagtttgatagttttctatactgataaagtttgattattttttctttcacctttgtctgttggctctatgagtgagttatataattttgtgtgtttttatgaagtgtattatcatcttttcaccttcagatgttagacttcctcaaatattccttttaaggctggtttaatggtaataaattctttatgtttttgcttgtttgagaaatactttattcctctgtctctgttttttttgtaggatcaaagtttgctttatataatattcttcattgacatgattataaaacaaattttatcacttagcatatattttcctattctttcctggcctataagttaatgctgagaaatccactattagctgaatgaagattcccttatagatgatgtgtcagctttcttctgccatttttagaacacctgctttgcatttgacttgataatttgacgatatgtgcatcagtgaagacctttttggattgaagtaacttggtggaactttcagcttcttggatctagatgttcatcttttgtcaataacttaagaagctttctgctattatttcattgaatataatttctatgctgtttatcttctcattctagaattttcatcatgttaattttttttcttttttacttagtgatgttgcataaattctgtaggattactttattctttttcttctttcttgtctatgtgagtcatttcaaaaacatggtaatagttggaaattatttcctctgctttgtctcttatgttcttgaagctctcaatagtatatttttaaaaaaatttgttcattgctttaaagtattttatatttttgtgggtacatagttggtggatatgcttacggggtacatgagatattttgatccaagcatgttctagtgaaaaatttttacaatgaacaattcaataaagttgcagaacatgaaattaacaagacaaaatcaataacatttctatttgcctacaatgagcagctgaaaaagaaatcaaaaaagtattcccatttacaatagtcacaaataaaattgaacatctaggaattaaaggactgaaagatctctataatgaaaactactgatgtaagaaattaacactgatgtaagaaaacactgatgtaagaaattagagggtaccaagaaatgaaaaaatattccatgttcattgattagatgaataaatattgttaacatttctatattaagcaaaacaatctactgatgcaataaaatcatgaaaataccaattacattcttcacagaaatagaaaaaaatctcaaaatgtatatgaaaccagaaaagacccagaatagtcaaaggtatcctaagcaaaagaaaccaacttggagtcacattatctgacttcatattacactacgcacctatagtaaccaaaccagcatgttactgccataaaaacagacacagagatcaatgaaacagaatagagaacccagaaaacaatctacacacctgcagtgaactcattttcatcaaagttgccattaacatacacagaaaaaaagacagtctctttaataaatggtgctgggaaaacagaatatctatatgcagaagaatgaaactagatccctagctctatccatatacaaaaatcaaataaaaatggtttaaaggcttatatctcagacctcaaattatgaactactacaagaaaacattaaagaaaatctccaggatgtttttctgggccaaaatttcttgggttataccccataatcacaggcaaagtaaaaatgaacaaatgagatcacatcaagttaatcagcttctatacagcaaaggaaacaatcaacaagtgaagagacagtccacagaatgggaaaaatatttacaaactatccatctgacaaggaattaataaccagaatatataaggggctcaaaccctctataggaaaagataaaaaaatggacaaagaatttgaatagagatgtttctcaaaagtaaacagaaaagtggcaaacagacatgtgaaaagatgctcaatatcactgatcatcagagaaagtcaaatcacaactacaatgagacatcttctcacaccatttaaagtagcttatacccaaaagacagacaaaaataaatgctgatggggatgtgaagaaaaaggaaccctatacaattttggtgggagtgaaaattagtaaagaccactatggagaacagttgacggttcctcaaaaaaatgaaaaatagagctaccatatgatccagcaatctcattgctagatatatacccaaaagaaataaatcagtatgtcaaagagatacccgcactcccatgtttgttgcactatttacaatagctaagatttagaattagcgtgaatgtccatcaacaaatgaatgaagaacatgtgttgcatagacacagtggagtaccattcagccatgaaaaagaatgagatccattcattttcaacaacatggatggaactggagctcattgtgctaagtgaaataagccaggcacagaaagacaaacatggtatgttatcacttatttgtgggatctaaaacttaattaaactaatgaacatagaaagtagaaggctgattacttgagcctgggaagggtactgggggcatgggggtaagcagggattttaacaggtatgtaaaaaggaataagacatactatttgatcacacaacagggtgactatagtcaataataacttcactgtacatttttaaataactaaaatagtgtaattatattgtgcataagacaaagtaaaaatgcttgaggggatagatactccattctccataatatgcttatttccaattgcatccctgtatcaaagtatctcatgtaccccacaaatatatacatttactaggtaaccacaaaaatttttaaaaattgaaaatttaaaaatttgaaagatatacttaatggaaaaacaagcaatttgtaatacaattattttatgtaataaacaattaggggacaggtttcaaaactattgacttggatttagtaacaacagtaagtattagcaattatcatgattgtactattagtcattctttcacttgtcctacttctctaccaactcttccgtttcctggtggcactattaatttcccttaatgtacatgggaaaattattaaaatataaagttagattgctttgaatttttattagtatttcatcaacttttatctcacgagaaagttaccatgtagaccttatataatttgcattcaacatggatattatgttttagccattgaataagattttagttgtatgttgatgctaataagaaggtaaacagaaatgatcccctaagagactgtataataatgttgcaaagaataattgctatctatatatatcttaaaagtgtgatattaatttaaaacacatgagattcttgtgttctctcataaggaatattctatagaataaataattgttattatgaactaagggcacttttcagatacaagtggtagaaattatttggtttttattaggcaagcacttttcatttttttcttggattctctgagatgcaggtatgacgttgagacataagttgccccagggagctttcctgagttgtcctgcaggcttggcataaggtggaaaaacacctgttcttatagggtaaaatgacctttttttgctgtaacatgtagacctctggaatctcagggatgaatggtttaaatgctggagtgaaagcaagtaaacactgggttttgttgcaaatattttgggggcacaatttctttttatgttgaagaatggtgtacattttaagctagaatactggtgaagagccccaatccttacaatacatcattagcatttcaccttgctcatctgtttgcaaaaacttctgcttctgcttttaaacaagtccacaggatatctgtcatctataacattgctggagaatgtaatgttgatgtgctagatgataatcagtatctattaaatgaggaatgatatctcaggtgactggcatatgataggtaattaatgttattggaaataacaaaaataaccaaaattgcaatattaatatttctggatcactgacttagtgccagacacattttaagtgttttacctgctttaacttttttccacaatacaatataaagctggcaaaagtacacataaatatctctatcaacattctggtatatttttctatcatttgctgcctgattttattaaaaaaattctaaattgtgtattctttttattctgaccctctgcagtctaattcattgaatatcttggaaactttttaaaggaaggaaatataatcagatctctccatttgttaactctttttagtagcttcccaatgccataataaatatttcaagatcctaataattatttggctccaacttgcctcttcagaatcatctgtttcttagtattcttctgcaaactaaacttgaagacttgagaactgtctttactactttgcctgcttttccttttgtgtcttcctctccccctcattcatcacctatttcttcacacctttcagttctcatcttgattatccatgtctccagtatactttctgttatcccaactggatatatccttgttattgtggtactgaagataatgcttttcacacattttattacttgcttatattttatctttcaacatagagtttaaggaatgtggggacagaaactatgtctacttttcttgtcttcttaaaatccaaagcagtggtttgtgtgaagcactttataagtattctttggttgaataactaatactttcttatatgttgcaaaatgaaggctttaatttgaacattactaggttcagatagtctctagtagtactcttttttctgtagtaataatgaaattcatataattgtgatgatatagaaataggaatctttaattggcatctggtttaccccacccactaaacatctttctttcacttcaagcaaaaacactgaaagaagaatatagtatcattcccaccaaaaatttaagacaaacaaaacaaaacaaaacaaaacaaacaggtttttttttttttttttttacctttggcagggattttgcaggtttgccgtgaagttttccaacaaagtgaacattttgtaagtgtgggtgaggaaattaaaaattcctgtagttttgaagaagctttgtttcacttttctccattatctcagataatgtagtattttttcataatgggaaaaaggaaaacaaaggcatatgacacaagataattgttatgagaatacaactgataattatctgaaaggagttagaataatgtagccaaagatatataaattgtctatgcttagataaaacaatatacatgtatttatacctggggataatttagtttttgtgcattatctattttgctcatatgtatttacaagaaagaccaagtgctaagagaattgtgggagaaaacttattcttctatcacatcagtgtattcgccatcgtaaaccataattaaaataaaccttagagaataaaacatgcatttgtttactctataaagcagcaatagtaatagatatacacttaaaacaagtctttgaggtccatgatcaatggattctactctactcataaaaaacaattttctaagaagtactcaatttttttcaaaaattaagctagtcccttgatcttttgttcttcaagtgaactgttgagtattttgtgagtatggctgaaatccttgtacctactactgctttgggttcatgctaaggtcttaataatgttagattttaagtaaacatattgtcaaatagcagctgaaattttttcagaaattattgaaatagagacttttgcctaacatggatttcactcatattgttcttagtgaagagacatagttaaaaaaaaaactatacagaagtaacttgatgttcacatttcaacagatgtttgactttaagacaaatgattttcaatcctttagtgaaggagtataaagatactagaaacttcaaattacctgcattgatttttgagtctttgatagagaaattgtatcgttcaattgtgaaggaaacattatggtactgtgggaaaatattttaatttctaaataagggacctgagatacacaattcaaaacaatcccctcaatgctaactagatagttgtgctagaaaaatgcataactcctcaatctacatgtctgcattcagcaggatgtttcttgatgtgtctaatgacttttcttaaatgaaaaatatgtcaagtaaaatggatgtgtgattgctgaaagaaatcctaatgacattaatttataggtttatgagttcctggagtgtgctgtattagtgatgaccacagggttctaacagatgctataatgtaagtctttccataatatttgtgagattgatagattattttatattttcatttcctcatttcttttattgaaaaacagtacttctctgactttatacgtacttaccttctgttttagttaattttcacactgttgacaaagacatactcaagatgggataaaaagaagtttgaaggactcacagttccacgtggctgggaaggcatcacaatcatggtggaatgcaaagagcaagccacgtcttacatggatggcagcaggcaaagagagagaacttgtgcagggaaactaccccttataaaaccatcagctattgtcagacttattcactatcatgagaacagcacaggaaagacctgcctccatgattcaattacctcttactaggaccctctcacagcacatgggaatacaagatgagatgtgggtggggacacagtcaagccatgtcattctgcccctggcccctcccaaatctcatgtccccacatttcaaaaccaatcatgccttacagacagtcctccaaagtcttaactaatttcagtattaactcagaggtccacagcccaaagtctcatctgagatgagacaagtgtcttctgcctatgaacctgtagaatcaaaagcaagttagttaattcccagatacaatgagggtaccagcattggataaatacagatatttcaaatgggagaaattggctaaaatgaaggggctacaggccccatgcatgccagaaatccaacagggcagtcattaagccttaaaattacaaaatgatcttttttgacttcatgtctcacatccaggtcacactgatgcaagaggtgggtttccatggccttgggcagctccacacctgtggctttgcagggtgcagcctccctcccagctgctttaaagggctggcattgagtgtctttagcttttccaggtgcatggtgcaagttgttggtggatctaccactcaggtgtctggaggatggtggcccttttctcacagctcctttaggcagtgtctgagaagcaactcagtgggagttccaactccacattttccttcttgaagtccctaggctacacagaatactgggacgatttttttctttctagcccaccaggcctgtgatggaaggggctgccgtgaaggcctgacatgctctgaagacatttcccccattgtcttggtgattaacatttggctcctcattacttatgcaaatttctgcagccagcttgaatttttcctcagaagaagttaactcttatggtttaatgtaaacacagtatattaaaagtctaagtatgtgcatggcaaagagacaaacaacttgctctttacttgagtctttaatgtcccttttatgtttgtaaatgctattatccaggtagtatcaataattttgcgtggatgagtcacttattttatgtaatatattttacaatagtgtcaagaacattcacagtgagaagttcctttagttctgcaatcactttgagatggaattaaagatgaaaataattatatgagtatatcagcatttcttggatattgtgcttcaaggaattttttggtaaaagttgacatataattgctatgctatacaatttactgattattttgtaaaatccattatttgtggtatattcacagaattgtacatccatgacaacaatcagtttcagagcatttttatttgtatcacaaaataaaccctgtactctttagtattttttcctcaccctgagtttctgcatttctcctgccctgctcaattgctaattaaatttgtatctatagatttgcctattctggaaattttaaaataaatataatcgtacaatatatagtttcttgtgactggcttccttcatttagcataacattttaaaggttcatttatgatgtagcatatgtaaggacttcattcctttttaatggcaaaataaacattttatatatgagcatacacattttatcgatttatttatcagttgatggacattaatttttccctatttttggctagtatgaataatgatgcttatgaacaagcttagtgtaactgtgttttcatttctgtcagatacatattcttagaagtagaattgctgtgttgtgtttccttgcatgtttagctataaaaggttaaactgtacgtgtaaacttttgagaaattgctagactgttttccaatgtggttgcaccattttccattcccatcagcaatgtgtaagtgttacaatgtctccacatcgttttcaacaaatgattatgtgtctttttattacagctaggctggtgggttgaagtagtgtcttgtggggaaaagaaagagagatcagactgttactgtgtctatgtagaaagaagtagacataagagactccattttgttctgtactaagaaaaaatcttctgccttgagatgcagttaatcgataacactagccccaaccctgtgctggcagagacacgtgctgtgttgactcaaggtttaatggatttagggctatgcagtatgtgctttgttaaacaagtgcttgaaggcaatatgtttgttagaagtcatcaccactctctaatctcaagtacccaggcacacaatacactgcggaaggccacagggacctctgcttaggaaagccaggtattgtaaaaggtttctccccatgcgatagcctgagatatggcctcgtgggaagggaaagacctgaccgtcccccagcccaacacccgtaaagggtctgtgctgaggaggattagtaaaagaggaaggcctctttgcagttgagataagaggaagtcatctgtctcctgctaatccctgggcaatggaatgtctcattgtaaaacccgattgcatgttccatttactaagataggagaaaaccaccttagggctggaggtaagacatgctggtgacaatactgctctttaatgcaccgagatgtttatgtatgtgcacatcaaagcacagcaccttttcttaaccttgtttatgacacagagacatttgttcacatgttttcctgctgaccctctccccactataaccctattgtcctgccacatccccctctcgagatagtagagataatgatcaaaaaatactgagggaactcagagaccagtgccagtgtgggtcctctgtatgctaagtgccggtccccagggcccacttttctttctctatactttgtctctctgtctctttcttttctcagtctcttggcccacctgacaagaaacacccacaggtgtggaggggctggcccccttcagtatctcattgttgattatatttccttggtgtctaatgatgttgaacattttgactttgcttataagccactgtattttttttcttttttggagaaatttctattcacatccattgcccatttttaattaatttctttttcttattaagttgtaagtcgtatttctgatacaagtacttcattagttatatcatttgaaaatagattctaagattatgtgggcttttgttttcttgatgctgtcctttgaagcacaaaagtactaaatttgataaagacctatttatatatttttcatatttgattgcttatgcttttgatgtcatatgtaagaaaccactgccaaattcaaagccatgaagattatcttctgtgtgttctttttggaattttatgattctacctcttaaatttaagcctttgacctacttttagtagttttgtaaatggcttgagaccagaagtcaaactttattcttttgtttgtgggcaatccgttattcaataagcatttgttcaagactgttcaattttttcattgaattgttttggcatctttgtaaaaaaccataaatatgtgggtatgtttctgggttctaaaatctattttgtttgtatatatgtctatttgtatgcctataccaggctcatttgattattatagatttgtagttggctttgaaagaagaaagtgtaaatcttccaactttgttattattattattattattttcagacaggatcttactctgtttcccaggctgaagtagagtggtgtgatcatggctcactgcagccttgaactcccaggctcaagcaatcctatcaccttagcctactgagttgctaggaccacaggcatgtgtcacctctcctggctaatatattattattagtattataaagacaagagtctccttatgttgcccaggctggtcttaaactcctttgctcaagtgatctacctgccttggcatcacaaagtacaactttgttctttattttaagacttttttggctatctttaggtttcttgaatatctttgtgaatttcagaattagtttgtcaatttactggaagaagccagttgggattttgatagggattgcattaaatctgtatatctatttggggagtggagtatggacactacaacaatactgtgttttaatctgtgaacatgagatgtctttccatttatttacatcttttaaatttctttcctctatgctttacagtatccataatgcaagttttacacttattttgttaaaattgattcctaatagttatattcttttggatgttatttgaagtgcaattgttttcttaatttcattttggatatttcattgcaattatgtaaagtaatttttttgtttattgatcttttatcctgaaaatttgctttgtttattgttccaatattttttctagcagattcctaaagattttctagatgtaaggtcatgtcatatgccaaaagtttaacttctttcttttcaatgtagatttatttttttcattttcttgcctttatcttgactagaagctccattaaaatattcaatatagataaagagtggatttagtctttctccattaagtatgatgttagctgtgcattttttacagataacacttaccagtttgagaaagtttccctctatccctactttacggggtactgttataatgaaggatattgaattttattaaattaatttttctgcatttattgagatgatcatgcagttttatttttctgttctaattacattttgtattatgttaatagagattttaacgttaaagcaactttgcatttttaataaaacttttacttattcagggtatataattgcttctgtatattcttacattcattttgctagcaaattttgtggatttctgagttcataatcataagatttatcgatctgtagtttttattttttgtgatatctttgtgtggttttactagaaggaattagttaaatatgttgataatgcatttttcttttctgtgatttgaaggattatttttgaggaattgttaatttttctgctttaaatgacttatagatttcaaaataaaggcatcttgacctaggcaattctttgtgggttgtattttggaccaattcagcctctctttttgttataggtctattcagatgttctgtttctttttgaatcagtttaatatattttcttgtctgtgtcttcctgtagtagaatttatgtcaaattaagttgggagtgggtgagggagcagttcatggttgaaattaataggctctcattatttttaccaggacttagtagattttcttgaataaatattgctaatattacgctttataattttaggtcaatgcctggacactttaattttttatagaaaacacaatattttaatgctaaagatgtgtttaaattgtttcttttttacaattgtgatgttctatgaagatttaaacttttgactgttaacagatgatttaaatagaaatgtagcatatgtactcagtgtacatgtgtatattcagcttgtcagcattgagttatctttcataaacttatatttatttatttgacacaaccaggtgggaggggttcccagagaaacaccagagagcctgtgcactgggaggagtgcacactggggtggagccacagaagttcatatgatttgcagtgaggaggagcccggcccctcctcttcttggatggaacctggaattcagtctgtgaggtggcaaacccaccggcaggaaaacacactctctcacttcactaagagcctctgttttgccttttcttcctttttacctaacaaaactctgcattattcaccttcaaagtccgtgtgcctaatttttcatggccatgtgacaagaaccttgcttttagttgaactaagaaaaagtcccacaacatatagatacacacacacgcacacacacacacaggcaaaaatgcaaaaacattcctcattttattttgttttacagatatggtcttttttacaaattgaaagcttattgctgccctgcattgggcaagtttaccagtgccatctttccaacaggatgtgctaactctgtcactgtggcacattttggtaaatttcacaaagttccaaacatttttattattattatatttattatgatgagttgtgataactgattgttgattttactgtagtattgtgttgcgggcaccagaaactgtattgggataatacgataaacttaactgataagtgctggtgtcttctgactgctctaccaaccagcctttcccccatttctctctctctccttaggcctctctatttcccgaggcacagcaatgttgaaatcaggcaaattagtaatcctacaaatggcctctaaatgttcaagggaaaggaaggctctgtcatctcaatatcaaaagctggaaatgattaaacttattaagaaaggcatgttgaaagctgatacaggctcagatctgtacctcttatgccaaatagttagccaagttgtgaatataaaaaaaaaatttgggaaagacattaaaagtgctacacatgtacacatgaatgatatgaaagtgcaacagccttgttggctggataaaagatcaaaccagtgacaatagtccccaaatttagacaaagcctaaaccagaacaaggccataattctctccaatgctgacaggggtgaagaagaaatctttgaatctagcagtggttggttcacgaagtttaagggaataaaccatctccataacataaaagtgcaaaataaaagaagctacagaagattatccagaagatgtagccaaaatagttactgaaagtggccacactaaacaggagatttttccttgtgtacagagcatctttctcttgaaagaagataacatttagcttttttatatcttcacaggagaagtcaatgtctagcttcaatgcttcaaaggacaggatgactctttcattagaggctaatgcagctggtggcttgaagttgaagccaatttttttttttttttgagatggagtcttgctctgtcacccaggctggagtgcagtggcaccatctcagttcagtgcaagctccacctcccaggttcatgccattctcctgcctcagcctcccgagtagctgagactacaggcaaccgccaccacgcctggctaattttttgtatttttagtagagacggggtttcactgtggtcttgatctcctgacttcatgatccacccacctcggcctcccaaagtggtgggattacaggcatgagccaccgcacccggttgaagtcactgtttatttaccatttggaatatcctagggccttagataaattattctaaatctactctctctgtgctctattaatggaatatcaaagcttggttgataacacatttctttacagcataaattactaaatattttaatcccactgttgagatctattgaccagaaagaaatattcctttagaaatattagcattcattgacaatgtacctggtcacccaagagctcttatggagatatacagggagatcaatgttgtttttatgcctggtaatacaacattcattctgtaacacatatatcaaaaagtaatttcaacttttaagtcaattaaggaataagtttcgtaagattattgctgccattaacagcaatttctctgttggacgttgtcaaagtaaattcaacactttctggaaaagtttcacctttctagatgatattaagaacatttgagtcattaaatgaagtaaacatatcaacattaacaggaatttggcagaatttgatttcaaatatcatagataatgttgagagcttcaagaattcaatggaagaagtaaccacagatatggtagaaatagtaagggaactattactggaattaaaagaagaacctgaagttgtgactgaattgctataatctcatgataaaacttgaatagatgagttctttcttatggatcagcaaaaaaatttggtatagtgagatagaacctactcctggtgaagatgctgtgaacattgttgaaatgacaacaaagtatttagaatattacttaaggttatttgataaagcagcagtagggtttaagtggattgattccaactttaaaagaagttctatcatgagtaaaatgctaccaaattgcattgcatgctgcagataaatccaagtcaaaatcacaatgagatgctaactcaagccagtcagaatggctatttttaataagtcaaaaacaacagatgctggtgagattgtggagaaaaaggaacacttttacactgttggtgagagtttaaatttgttcaaccattgtgaaagacagtgtggtgattcctgaaagacctagaggcagaaatataatttttcccagcaatcccattactaggtgtatacccaaagtaacataaattgttctattataaagacacatgcatgcatatgttcgttgtggcaatattcacaatagcaaagacatggactcaacctaaatgcccatcaatgacagactggacaaagaaaatgtggtacatattctccttggaatactatgcatccctaaaaaagaatgagatcatatcctttgcagggacatggttggagttggaggctgttattcatagcaaaataatgcagaaacagataaccaaataccacatgtcctaacttatatgtgatagctaaataatgagaagatatggatacatggggggtaaaaacacacagtggggacttttggaggtcaggggatgcgaggagggagaggatcagaaagaatagctaatggattctaggcttaatacctgggtaatgggatgatctgtgcagcaaaccacgatggcacacgtttaccttgtaacaaacctggacatcctgcacatgtaccttgaactttaaataaaagttggaaatttttaaagaaggaaggtcaatgggtgcagcaaacattatttttgtctttttaaaagacattgccacagctccccaaactttcagcagccaccaccctgattagttagcagctgtcatcatcaatgcaagaccctccacctacaaaatgattacaactcactgcaggctcagatgattgttaggatttttaaagcaatgaagtattttcattacagtgtgtacattatttgtaacatatttatattgcagacttaagagactacagtatagtgtacacataacatctatatgccatggaaaaccagaaaattttgtttgacttactttacttcagtgttctgggaccaaatctgcaatatcttggaagtatgtcttgtataagtgaacataaaatgagatctactcttttaaaagtattttaagtgtatgatacattattgttaactatggccacaatgttgtgcagcagtgctctgaaacctgctcatcttatttttactggaactttatactcattgaaaagcaactctcaatttcctccattctccagccactggtaacctccattctactctccgtttctttgagtttgactgtttcaaatttcttacacaagtagaatcatagagtatgtgtcccattgagactggcttatttcacttaaaattatttcctgaaggttcatctatgttgttacatattgcaggatgggtggatcatatggaagttctatttttaattttttgagcaacctctacactgttttcattttggctgtaaaaatttatattcacactgacagtgtatgaaagtttcaatttctccatttcctagccaacaacttttattgtgtgtgtatatatgtatgtgtgtgtttgtgtctgtatgttgataaagacatggtaagaggtatgaggtgatatctcattgcagttttgattttcctgatgatgaatttacattaattagttttcatacagctgttgtccatatgtacaacttcctcagagaaatgtctttttcaagtatttgcctatttattaatcatggctttttttctctttttgctattgagttgttgcagttcctaatatattttaggtgttaacctctcatgagatatatgatttgaaactgtttcccattcccattttatcttttcactctgttgacttctttgccctgcagaaactttttagtttgatacaattctactttcatatatttgaccttgttacctgtacttctgaggtcatacccaatagaccattgcccagcccaatgtcataaaactttttccgtgttttattgtgagagttttatagtttcagggcttatgtttaagtctttcatttgttttgtgttgatttttgtatatgacataaactaagggtccaattttattcttttgcatgtggacatctggtgttctcatgcagtaccgtttcttgaagagagtgacatttattgagtatatttgagactcattgaatataagtgcattgtatatttgtgactttatcatctgggctctctattctgttacttaaatctctctctatttatgtctttatgtgaatatcatgttattttaataactgtagcttttaatatattttgaaataaggagatgtgatgccctataactgtgttttacttttcccacattgttttggctagttacttcttcctggatcattatacattttaagatttttttgtctttgtataagtcattggtgtttcgatagagattacatttaatatgttaatcactttaggttgtatagatgtttctgtaacattaaatcttccggtcaatatactatgtctttctaaattagtataatctttaatttcattcatcagtgttttgtagtttttagtatacatgtctttcttccacttgttacagtttattcttatgtattttgtcctttttgaggccattgcaaattggagtgttttgttaatttccttttctgatagttctttgttaatacacagaaaggtaagtgatttttgtatgctgattttatatgctgcaaatttactgaatttatgcacttgttctaataatatttggtggcatctttagggttttccacatataatatcatgtcctctgcaaacagaggttattttactgttgattcagaagcctgttgctttttttctttttcttgcctaattgttccggctaggatttccagtatggtgtataatagaagcagcaagagtgaacatcctttccttattgtgaaaacagatgaaaagttttcagtttttttttaatcattgagtatgatgttagctatgagcttttcatatattgcctttatcaggttaagataatttccttctatttcttgttgcaggaagtcagggaccctgaatggagggactggctggagctgaggcagaacatcataaattgtgaagatttcatggacatttatctgttccaaaaattaatacttttataatttcttatgcctgtctttactgcaatctctgaacataaattgtgaagatttcatggacatttatcacttccctaataatactattataatttcttatgcttgtctttactttaatctcttaatcctgttgtcttcataagttgagaatgtatgtcacctcaggaccactattgtacaaattggttgtagaacatgtgtgtttgaacaatatgacatctgtttgtaaaacatatatgtttgaacaatatgaaatcagtgtaccctgaaaaacaacagaataacagcaattttcagggaacaagggaagataaccataaggtctgactgcctgaggggttgggcagaataagccatatgtttcttcttgcagaaagcctataaatggatgtgcaaggaggagaaataccgctgaattcttttcccagcaaggagtaaccctggggaaggaatgcattcctggggagaggtctatgaatggccactctgggagtgtctgtcttatgcggttgagaaaaggactgaaatatgccctggtctcctgcagtaccctcaggcttactaggattgggaaattccagcctggtaaattctagctagactagttctctgctctcaaaccctgtttcctgttaagatgtttataaaaacaatatgggaacagcaggacatagagcctcatcagtaattctaattctgcctttgccttgtgatctatatggccctttgaagcatgtgatccttgtgacctactccctgtttatacaccccctcctcttttaaaatccctaataaaaacttgctggttttgcagctcagggtcgtctgcacagtcctaccaatatgcgatgtcaaccctggaggcccagctgtaaaatttctctctttttactcttactctttatttctcagaccagtcaccaattagggaaaatagaaaagacctacattgaaatattgggggcttgttcccccgatatcatttctatttctagtttgtttagagctctcttttaaaaactcataaacaattgatttttttcaaatgctttgttttgcatttactgatatatcaagtgatttttatgcatcattgggttaaggtgatatgtcacatttgctcatttttgtgtgttctattatccttaaatctagggataaatttgtcatttcttttaggaaagaagcaatgctgagtcttgaacatagtaaaagccaagcaacactactggtcttgtaatatcaaaaggaagagtgagactttcttcacaatttaattattgagtagtttctttgcaacagtaaaaacaacaaaattctgctgaaaatgaaaccaaagaattctgagtatttgcaaaatggtattaatattgtgaacggatgtcttaatattgggtcaatgtataaagtgtgaaacacagctcagtaatttttgtgcatgtgccacttgtgaatagaataatgtatttcacataaacccatatggttttacattattttttatttttccttgtttttaagtatttgactaagaatatttctaacttttaaataggtactaaatctctggaaaataaattttgacctaacagtgtaagttataaaaatatgttttgtcacaggaggaaggaaatcctctgtatcaacctcttcatgctggaattaactgaaggaattctatcttttggtcattccagcttcaagccttttatgtaactaatcccttttctccttctttcctgttttagcaaactttcagaaagaaaacaggcaacatcttgtgatgatgaagatcacagttgacacataggccagcaggaacctaatcacatgcaagttgtggtattggaaccaggtgaggtcgtgggctgcaacccgaaggtgcttggctcctttgtgctgcatgacaaactcaatccagaaggctgcttgatccaggggcttaattggcaaatcatggcgaattattgataacttcatagcattctctttgtagctgaaggataaacataaaaataccaacattgaaagtaaatttatttcctaagtctatggatggtctttgaaaagtgtcacatcaatgcttcaaagtaaatattatagaattgtcataggaatcgaatgttttggtttggacaaatgtagaaagtttattttttaaaatggaattttataaagaaaaatatgtcttaaattaaaaatggaaggtctgatgagaaagttaatgtctttgtagcagaggaaatattttgagccattctatgtgctacaggtaagacagtggaaatgcaatctgagattgatcatcttgatattttattttatttttttttgagaaagagtctttctctacggcccagattggagtgcagtggcatgattatgggtcacagcagcctccacagtgtgggcttaaacaatcctcccacctctgcctcctgagtagctgggactgcaggcatgcaccactttgcccagtaatttttaaatatttttttgtagagatggagtcctaccagtttgcccaggatggtttcaaactcttgggctcaagtgatccttttgctttagccttccaaatttctgggactacaggtgtgaactacctttatcgacccattttgatatttttaaggaaaaattgtttcacagctggtgtaatatttctaaattagtctttctctttctaccctactattctgtgttctaccatattttcctctcagtagtcagaataattttttgaaataaaagccagattatggcattcctctgataagattttcacctggcttctcactatattaagaataaaatctaaatctgtctttgttctacagaaccctacatggtcaggcatgggcaacttcttctaacactttccccaaccaccttctctcctagaggcattgcccttctattgttctttgagctccccaatgtgttctcacctgagcccctttacaccctttatcccctctctccctctcttggaatattcctccttgcaacaacttgaggcttgcttctatatctttttgaggcttccccttaaataatacctgttaaagaggcttttcgtggccacactatggtagtacctgtaggatttcctctattgttttgtgcttattttgctgtttaactcctggaacttaaaaatatgttacatgtcttctcaaataaaactttaagtataaaatacataaatgtacacaaattcagtgaatagctcaaaattttaacattaccttgaacaatatcctgatgtgaacaccaacttacctactacgcagattataatataagacatcacaacctgcctagaaaaactctgtcttcttgggccattttagtcactacttttgtcctcaagttaaaactaccttgacttctaatagattaatattgcttgtttacataatgaattatataatatatactcatttgtgtctttttttgggtagaagttattggctaattccattgctgtaatatgattcagtcaattgacaaataccacagattatctcctatttttatgactgatggatatttgggttgttaagatttttgaacactattactaattctggggtaagcaaatgtgtgtatatcattagatatacatattaatacatttttgatgggtatatacttgagagatgagttgctgagaaaaagatgcatgtagaattatgatgttttgttgactagctttttaaatacacaaatttaatttccaaaatttagagttgttttttaagttataattttttggataatttcgaatttatttctagtatggctagagcatttcctttttatgcttttgaatcttatcacatttgctaagtcctgatttttggcccagcagaagttcaattcactaactattccatatactcttaataaacgtatattctcaatatacattcacactcacctccacacctccacacataaaaatgtgtgtgtatatatatatatatacacacatatacacaaacttactatatatatacacaatacatatatatgtatacacacacatatatacaataggttatatttatgctcttcaaatgtttatttttaagtcacttttttttctctgtttaaatttagtatgagttctagtagattcacttttaaatctactatcttattctgtattttattttctgttttccaatctgctgtatgtttcttttctaattctttcctgtttgcttttaaactatttttaatcattcactgtcttattatcttcctggtaaggtattttcagtatattttctaaggtggtacctccttatatatattgataatagtaatcaatagtcacagcattttctacattatttcttttggagcacagaaaaattattacagatttattttctcaatattaaaactttgtgcttcaagggacatcttcaataaagtaaaaaaaaagaatcaacctataaagagtgggagaaaatatttaaaaatcatagactgacaaggcattccaccaataatataaaaataattcttatgaatcaataataagataaaaatgttagaaatgttcaaaagataggaataaaattttctcaaaagaagacgaatgacttgccagtaagtgcatgaaaagatggttatgtctttagccacaaggaaaatgcaaattaaatccacaatgaaagatcattttatatccactgggatccctgtaacaaaaagataggagataacaagtgtagggaagagcatgaagaaattggaaccctcctgtacagctagaagtaacgaaaaacggtgcaagtactttgaaaaacagtttagcagttcttcataaacatcaactttccatatggctcagaaattccactcctagtatcttctcaaaattagtgaaaacaacttttttcacaaaaaatatgtatagcagtgtttataagagctaaaattggaaataactgaaatgtctgagagctgataaatgggtaaattcaaaatggtacattcatcaaagaatattagcaataaaaagaaaaaatgttctgacactttcaacaatatgggtgaaactaataaaagacattgtactaagtcaaagaaatcatttatagaacactgtaaattgtatgatttaatttacatgaaatatccagagagaataatctattgagaaagtaagttgatatttccctaggactggaggtttatcaacagtgattttatgcattttgaggtttattttagggtgataaaaatgttcaaaaattatattatggtgatggctttgtaactatgtaaatgtactaactacttttagatctcacttttaaataggtaaatattatgctatgcaaattgtatcttaaaataatgataatactaaaaatacattattgagcatgaatacagttatactttcagaaattttatgtattgaattgaaatactttattttatttctccaagttcattatttcattgtattataatccatcattcaaaaaacttatattttaaacaattatctatatatgtttaaaaatatttgtgtgtagaaggttgttacagtaattggtgacccattaaatatatgggatcaaatgtaactaaaataattggtgaaaaataaaagcaggtttcaagttggttaaattatttaaattctttcaaaattggtctcctaaaaggggtaagacatgtattcagtgttgtcaaaagaatctgtaaataccacatagtaaaaaaaattgtcatactcacacagggtcattaatgactgtcttcagtgcattgagcaaatctgtacttgacatggtcctgatgtccacattgagggccttcatgtgagcaatgttatcaggttgatctgcaaacaaaggaatgcccaccatagggatcccatggtagattgcctcatagatgccactggtttcaccatgagtcataaaagatttagtttttggatgacctaggattggataaattttagcaaaattattcataagactaaaatgagaaatgcacaatagaatgctctgaaaggggcagtgtctactaaataacagattattatacacatcaaactccattagaattgctttcggatttcagagaaagaagcacctaattcttctggaggtaagtgaaggctacatgaagaggtgggggcgtgtgtgacttcagactcaaaaaatgaattgatattgccaggtggacaaaatgaaaaagcacattctgaatgaaaaaaatgtgcaaaaaaaaagagaaaagaaaatcaataatattgtgtatgttagagcattttcccttaaatacatactgcggtctgagtgggatatgtggtgtatgcaaggcaacagggagtgtggtggtggtattggaatagaagaaaggcaggccacattacatcaggaaacgtgttatcactttatgataaagattgaggatttaggccgggtgcggaggctcatgcctataatcccagcactttgagaggcagaggtgggtggatcacctgaggtcaggagttcgagaccagcctggccaacatggtgaaacctggtctctactaaaaatacaaaaattagagaggcttggtggcaggtgcctgtaatcccagctactcgggaagctgaggcaggagaatcgcttgaacctgggaggtgaaggttgcagtgagccaaggtcatgccaatgcactccagcctggggacaagagtgagacttcatctcaaaaaaaaaaaaagattgaggatttattttcagaaaatgcagagttattggtaataaaagaggcactgttattttttagtgtcttttgaaattaaccctgaagtagggaaaaggacaggtgtaaagctgtacaaataggagacagagagacaatccaggaagttattgggaaaccccgtgagaggtaattatatctgaaataaagataatttgattctgaacataaagaatgtgagtgtctataataaaataccaactatatagttattttcctggtaagactggaaaataaatataaagtagttagcctttatatttgagttttttgataataaatgttccgtaagtttctttcaggttgagctatccttctaattagctgttagtcatatattcagtatttgttctgcagagtattaccaagaaggtcattctgggatatccacttgtacagctgagtattggatgctaaagtatttggtctctttccatccacagaacctgttggggtaaagaaaatatcttgttccatgagtagaatgccaaagctataagatgttagaactctaaagaaattgtcaatcaactagttaaaccccttccatataatagatgaaaaaacgagaacaagcaattttaggaaatgagtactactaaaagactattgaatatccacatttcatgtcttttattatcaatttggtatattagaaaatcatgatgttttcaacagagaagcttagacacttgagagtatcaataaaaaattcaaaaatttaagaaattattagacagtcattataattctactgtaaaatacagtaacaaattagtgacaacctatacatttattttatgtattttatactacctgtaatcttccaaatttaatgttagtttatttcttgagtgaaatgagaagtgttacttatatatatttttctgtaagttattttgttagtgtttgacatctttgatttataaaaaacaaaatctataaaatcagctacctgtgagaaataaatcagtgctacataggtagtacatataacttcttgtagattacacattacccagcactacatccaagaaaaatttcaagtgacaatttctttcttttcttttcttttttcttttctttctttttttttttttttttttgagatggagtcttgctctgttgcccaggctggagtgcagtggcaccatctcagctcactgcaaccctcgcctcctgggttcaagcgatttttctgcctcagcctcccaagtagctgggattacaggcatgcactgccatgcccagctaatttttatattttttagtagagacggggtttcaccatgttggccgggctggtctcgaactcctgacctcaagtgatctgcccacctaggcatcccaaagtgcaagtggcaatttctgagtcaaattcaaagtactatcattttgctagttttggaaattcttccaatgtaggcgaaaagagccaattggcaatttatgaataagaatatacacactaaaaattgtaaaattatattttgctaaattttgcttaactgatcattaacacttagatgctgctataaagcatcgacagcatagattaatatgggctgctttagccaagccatacccatagacagtaccaaaataagatactgattttagattccccaagcaatccttataaactggagtgtaatttacaagtgttttccttgtatttgctatgtgagtgttaaagtaactttgtgtttccagaaaaaaattagcataggtcattaggagaaggctatgtcagagaggaaactaaaaagtaactcacaaatacacaaagacttcaagtgtattctgcatactacaaaataagttcctactatatttcatggagtgagggcatctgaacctctttccatgcctggcttccttctgcttgactccttcttatattcccttctccttcctccgttgggaggaggtgtttttctgatggttagagcagaggctttatgggaccacattttataatgcacggagtctaccctaaaagcaggattctgttccttccttttctatcatattttcctgtttaagacattagcaaggcccagtaaacagggcaggcaagttcttctgcttctctaaatctacttggctaggtggatacctccagaatagcggtttgtcagcctggacatcttttctctgaatgcattctgaattgcctactaaataggtctattccaaaatgtacaggaagtacaggagaccagattacctagcaagcctaaattgaatgatgcatttcagacttttttcaataccttattgttattgtaatagtgcagtaactgattaaaatgtaagtgattttaaataatatctatagtgtataccatgttctcaggaaacttgtaagcaaaagggacaaatgacagggcagaatttggtgatttctatgtacatgcctacaatactatgataataccacaacttcacctgcacctcttaaatatattttttctgatcacaatattaatgtcagaatttttatcaatcaaacacaccctcgttattttagtatcttccatatatatttttgtttttgaaccaatatctgagataattagagctatcatatcagttagtttttctggcagaaaatttctgtgattggactctttacagagtttaacagactcattcagtagctgtccaccattaagacattttatctaacctttcgtggaatctgggcaagagctgatgcaatcacgttggccctttcttctgtgatgttactgaccatagacttaagcaagactgccacgacaccattttctccagagctctgcacaaactcttccattttctgtgaagaatttgttctatcacaaaagagtgtcagcatagcaaacactatagaaaagattagtacatacatctaagaagagaaaatcaagcattatcagaaatttttggagtaatggctattttttaactgacctaatctctttctttggaagaagttatggaatatgatatacatggcatctgttatggctatttgtgtaaatatgtgtgtctgtaaaaggaaaagatgaaaaacaactatgacactatagaagaaggagacaatgctagaaaatattatacccagactcttcatttacaatactgtaattactaatatgggttcttggaaggtggcatttgttgtgtttaattccatatgttgtagttctactaaattccttgtgtctattaaggcagggttttttgtttgtttgtttgtttgttctttctgtagagtatttttagttgggagtcattggaaccattacctggctatgagcagtgaggaaaagttactattgaaataattttatatgtctatttctttagctctgtaattctttatacctcatttaaaacttgtcagattatgtctttttccctaaaaaaaaatctttaaaagctgaagtttaataatgatggagattcaagagtctgatactgtggtgtgaaatttctgtgaactagtcctgagaatcccatttataatacagaattatgcagtatatagttacataactgagtgattgtatttctcaggtcattgtttaaatattactaagacactttttttcctgaaatcacactgcataaaatgatatgctactggccaggcatggtggctcacacctgtaatcctagcactttgggaggtcgagatgggcagatcaccaggtcaagagattgggaccatcctggccaacatggtgaaactctgtctctactaaaaatacaaaaattagctgggcgtggtggcacacacctgtaatcccagatactcgggaggctgcggcaggagaattgcttgaacccgggaggtggaggttgcagtgagccgagattgtgccgctgcactccagcctgggcgacccagcgagactccatctcaaaacaaaacaaaacaaaacaaacaaaccaaacaaacaactgatgtgctacctataactgcctgtgagggaccctcatcatcacttttctgtgtctcacaggggcacttaatcctcagtggaagaatctaccagtcatttttccagtggagatctcttcactatcttgagtagctcattcacacaatataaagcccttgttgaatatgtgtttgcttgaaatttattgagaattactctgaattgtggtttcccttatgttctcatttgtaaatgtaaatgcatagtgtaattccacattgctcagtgcatacgcctatcaagacaaaataaagagaaagagaaatgtagcgccaaaagttttcagtatataatgtcaaaattgaatacccatctttttgttgttgttgtttcttttgttttccatttattatttatttattttctctgtaaaataatgatgaacccattctgacataaccggtatactttcagatcctaaacatgggaggtaaactttcttttaaaaacttgtttaaaaaaagaaatcctaaagtttgtgtatgcacaacatattttgccaagtatttttcaaaaatataatttgagccttatgacattagttttaattggagagtcactgtactactattccaggtagttcttggggctcccaggtattctgtgtgactcgttacctgtgtgaacacaaagtatctgaaacagttctcaatttagaaagtttattttgccaaggataaggacatgctcatgacactgcctcagaaagtctcaatgacacgtgctcaaggtggttggggcacagcttggttttacacattttagcagacatgagacatcaatcaatatgcgtatgacgtacattggtttggtcaggaaaggtggggcaattcaaagtgatgccttcatgtcatagataagagttaaaaggttgcattcttttttgggtcttagatgagccttttgctgaatacacagtatacatatgagagaagggttgagaaatagtcacttatgccttagtctgactcagtaaatctgcattttttccataaacaatggtgaagggatggctttgagttctgtcctcttttgtccctcacctgtgaagataagctatcaatttacatttccagggtgaaattcaacagaaatgtttcaggttaaagattttgaggcccacaaggaatttcctcttgggaagattgtaagggaggtatgtaacttaaaaacaacaacaacaacaacaacaacaaaaacccaactttgtagctattttatttaggaataaaatgggaggcaggtttggctgatacagtttccagcttgacttccctttgacttagtgactttgggttttcaagattatttttctttcagacctgtagccacatttaatggaacttgtgtttgatgttttttctcaatgcctcgctgcccagagtcttcttcatccacccaatattgaggtagcatattgtctgtttatacactcatcagtgatctcattctgggatatcttcatgaaaataatatatcagtgtacaaaatattagagtatgaaaagcttaaaaaaattaaatttccctcatactctctgtctagagctattcctgatttaaatttgtatgcttttattatggtttttattctatttatataattcactgtgatgtttatttagataattttaatcttattgtatattccttttcatcctgcataaaaattgtgatctagttctattcatcattttgtttctcagtttccgacaattcttgtattatagctgacactgtaattatacatattttgataaaatgattgtaatggcatagaatgcatattgtatacatttttacatagtacccaatagtttttcaggccttctgcccttctcttccctctgtagtagtccccactgtctattgttcccatttttgtctatgtgtgccccaagcttagctcccacttttaagtgagaacacatagtatttagttttctgtttctgggttaattattctggttcatgtgtgtgtgtgtgtgcacaaatctccatgtatttgtttgtttatcttggctttaatctgtcattttattttcttttttcaaatgttgtctgcctatctatctatatatttatctatctaatctatctatctatctatctattatctatttatcatctatctatatatttaagaatgaggacatagaatgattcactgggatatctttgtatctgtgaaggacttagtatctggttggctttgatttttatgctgaacgcgtacaactactagaccttacctaaagggaaccaaaaatttcataaaaaagattatactttgatgtgttacatcaattctagttttctcattttaccctggtgaatttatttcaatttctttaaggaaaaactctctagtttttgtgtggaaagtgcaaagaggaacgtattatgtaatacagtaagggttagtgcatttcattttcatgtctttagtttcctttagtctgtaattatcccttcattttttgtctctgttaatttttgacttctagatgaattattgaccagttgttttgtagaatgattcttattttacatttgtttaatgttccttcatgattaagttgctatcacacattttttgaaagaatactgcagacatgttgttgtagtcttcacattacatcatttttgggcagcagatagtgttgatttgtcatgctggtgatactaactttgatttcttggttaagatgctgtctacaggtttattccctgtaaaattataatttctcattttggaattagaagtatcttgataggagactttgagactgtaaatatcctgtttccattacatcctttccctctaattttagcatccattcaaagataatttttgcctgaattaaattactgtggagtttgtctaatgattatttctatgtctataatttctttaacaattagtaagagaaattctactctaagaaagaacattttttcccttttatttccttatactggtttctgtcaatatgatttcatgagtatttggtttattccaaaggttacaatccacagctatcattattccattgctcaaattggtccagattcgattcattgggacttccttcagtttccctctatatttttctgatatgttgtcatcatgttgtatacttatttactttctggcacccctagatatttcaggcacatcctgtacttttgttgcctcaggggtaatgtcatttatatcttgaggaaggcatggttcgttttattggagtatagtgtctagaagcaaaatttcaagtacttagcatgttcattgcatctgggatattattacttctaggccatttacgcatagacattttggaaatgtatctatgcataacttttcattaacagcttaagagaataaataaattatcatttccataaaatacagaaaaaggagagtgtagtaagctaaaacatggtaaatctaaatagtaaatatttacagataagctcaaactaataatttaatgtaaaaagttattttcatttaatgtcatgtaatagttatatatcaatttaaaaaagaattaaataaactcacccattatggtagagattctcagatatttcaatctagcttttatttttgtttaaaagagaaacacctaataaaaattacccatattactataaaatatatacagattttacaagaggcatatacccaatagcaaataaatgaaaattgatgcaatgctacaaaaatcaaacaaagcagaattaagatgcgaagtatcaaatgtgataagtgaatcatttcatgtggatagaaataattcacttaaaattaacaataataagtatttggagattgaaatatatctcagaaactgatagattgaacagagaaaataaattctatgaaagttgattgtattagcaacaaaagtaacaaaaataacgtactgaatcctgcatcttcaaatagagtataaatattcttttgaagtgcacatgaaaacttttataaaattaaactaaggcaatgtcacagatgaaatctccacaaattctgaagtatatatatcatatgtatctatataatgtgatacaattaaaataattataaacttaaagagaatgtattacctttcaaatatacacatttaagaatttcattcagtggagtggactgtgcttaccattcatgacccaagtctttactaccttttctgctccaaacacatataccatgaagagaagacggcatagaatatactcaggtaagtatacaactgagaaaacttacacaccagttgttagcattagagaaaattatatgaatagattcttataggagctataacaagatggttttggcaggataaaaaatgtggcaaaagccttaaaagtggaaaacaaaatttacctacggagttcagggaatttctgttctgaaaaaatgtaagttgtaataactaaaaaattaaaacaaattataatgaaactgatctctctagatgacagcagacacatgcaggaaatgaaagtttgcagaaattaacagctgttgaagattaactcatgaaaaccacatgaggaaataaccaattctacacaatagtaagattttcacccaaagtttataaatataggaaaaaatcaaaataattttttttctcagagatgagaaaatacttaacataaaaatggaattgggtgagaagcatgaatagaaagaggaacatttagaaattgtggaaattagaaatacagtcactgattgtataaaatgtaatagagttcacaaaataaaatggaaccgaatgaacgaataaaagaatgaacaaaacctgcaataaggtgaattagtaaactttctctttttctgactgaaccttgactgatagagcttccaacagaaatcacctaatactgtaggaattgccattaagctgattaaaatatgaaagtgttatttgctattaccacatgttagagccctcctgattgcctgctttacttctgaagctctgtcattatggtttcctggttttaatcactcattctatgcttcactgaaatattttgaactgattcaatgtgtttctctcaaatttaattttattctatcctgtctcttgcctcctgcaggttctcactgtgagcaatccagctccagagcttaccttctctgacctagggttcctcatttttttttttttaccagtttatctgaacttcattgatcttgttcctttgccaatcactctgagccactgtcatcatgactcaggattctagaatttgaacaaattataaatttgccctttgtatcttctgtatcccaaagaagaaccagtagacggtaccacaagagaaaaatgagtgcagtacatgaacaaaacacctgaatgaatcacaaacaaaaagagatggttgattagatttataattaagcatttgccaatcaaatcagtgattcatttttatattatttggattggtaaaatttaacatccaccatagatgaagcacgaaataactgtccactccagtgctgcataggtgggtgtacatagagggaggtagtgtttgaaggatacccctgggctcaactgactcaagctagctcagtcttggtaagagggagactggacacttctggtacagttgggctgcagacacactgtaccaactgtaagttcactttggtgagaatcttcatatgccctcacttgaaagaattttcttttccagataagtttatgccttttattcatccgaattttaccatgatgctgtgctcaaagatacaacaacatttgaggcactaaaaaatgaaaaattttaaatattgttgtctgctctaacagttttcaatttactgaaggtggaaattttacagttattaagaaataaagtaaactgaaaaaacataggtggagtgagactgagagaaaaagaaatggagagagtcatggaactcttcccagcagggtgaaaattattggatatttattaagaaaagggatgaatgaaatgaaaattaacatggctaaaaaaaggtctcaacacaacattatgagaggtaaggtggtcaaatgagactttttgaaattaatccaacctaaaagggccccaaactaatcagtttcatttatcgcagtgtggagtagtttaaaaagcaggaatgcagagatcacagttagaaagctgcttaataatttcttcagataatgctgaggcagattaatcaagataaaaattaacacacaaaaaaagggtttattggtttaaggccctgctgttgacccaaagccttgtgtaagactgtcaggggatagggaacagaaattccagagactccttaatacaagaccccatgtgatatgctaccaagatgcattggggaagccttgaccgaggttatagttaggttgagaaaccataaaaatataaagattaatagaattatgaaatttgtgatatttaaacaggcttaatttaaagaaagtgtgtctttttaacttaaatgtcttatgaaatggactttatgtctggctggaaacacttgttctgcctattgataatattgtaacacaaaacctgctgataaagtcctaaaggagcttaagtaaaggttaatgaaatgaaaaggaaaatgtataggaaagttggtatttttgaacatactttatgtgaagtagtatctattttatctgaatgtgtcaaggttgaaggacactgtatctaactaggaaatgtttcttgaatctaatattgtataacagaaggtatgcaaatttgcccttcagccaacattaattggacatgctaaatgaaaaccactatggtagggtggagtcaagatggccgaataggaatagctccagtctacagctcccagcatgagcgacacagaagacgaatgatttctgcatttccaactgaggtaccaggtgtatctcgctgaggattgttggacagtgggtgcaggacagtgggtgcagtgcactgagcatgagccaaagcagggcgaggcatctcctcatctgggaagtgcaaggggtcagggaattccttttactaaccaaggaaagggtgacagatggcacctggaaaatctggtcacttccaccctaatactgtgcttttccgatggtcttagcaaatggcacaccaggaggttatatcccacacctggctcagaaggtcctacacccacggagtctcgctcattgctagcaaagcagtctgagatcaaactgcaaggtggcagcgaggctgggggaggggctcccacaattgccttttgtttggctatgccctgaccccagaggtggactctacagaggcaggcaggcctccttgagctgtggtgggctccacccagttcgaacttcccagccactttgtttactcaaaaccgctcaactatatggaaactgaacaacctgctcctgaatgactactgggtacataacaaagtgaaggcagaaataaagatgttctttgaaaccaatgagaacaaagacacaacataccagaatctctgggacacattcaaagcagtgtgtagagggaaatttgtagcactatataccctcaaaagaaagcaggaaagatctaaaactgacaacctaacatcataattaaaagaactagagaagcaagagcaaacacattcaaaagctagcagaaggcaaaaataactaagatcagaatggagctgaaggagatagagacacaaaaaacccttcaaaaaatcaatgaatccaggaactggttttatgaaagaatcaacaaaattaggagactgctagcaagactaataaagaagaaaagggagaagaatcaaatagatacaataaaaaatgataaaggggatatcaccaccgatcccacagaaatacaaactgccatcagagaatactataaacacctctatgcaaataaactagaaaatctggaagaaatagataaattcctcgacacaaacactctcccaagactaaaccaggaagaagttgaatgtcttaataggccaataagaggctctgaaattgaggcaataattaatagcttaccaaccaaaaaaagtccaggatcagacggattcacagcaaggacttcatgtctaaaacaccaaaagcaatggcaacaaaagccaaaattgacaaatgggatcttattaaactaaagagcttctgcacagcaaaagaaactaccgtcggagtgaacaggcaacctacagaatgggagaaaatttttgcattctacttatctgacaaagggctaatatccagaatctacaatgaactcaaacaaatttacaagaaaaaaacaaccccatcaaaaagtgggcgaaggatatgaacagacacttctcaaaagaagacatttatgcagccaacagacacatgaaaaaatgctcatcatcactggccatcagagaaatgcaaatcaaaaccacaatgagataccatctcacaccagttagaatggcaatcattaaaaattcaggaaacaacaggtgctgaagagggtgtggagaaataggaacacttttacactgttggtgggactgtaaactagttcaaccattgtggaagtcagtgtggtgattcctcagggttctagaactaggaataccatttgacccagccatcccattactgggtatatacccaaagaactttgaaacatgctgctataaagacacatgcacatgtctgtttatagtggcactattcacaatagcaaagacttggaaccaacccaaatgtccaataatgatagattggattaagaaaatgtgtcacatatacaccatggaatactatgcagccataaaaaatgatgagttcctgtcctttgtagggacatggatgaagctggaaaccatcattctcagcaagctatcacaaggaaaaaaaaccaaacaccgcatgttctcactcataggtgggaatagaacaatgagaacacatggatacaggaaggggaacatcacacactggggcctgttgtggggtgggggcagtggggagggatagcattaggagatatacctaatgttaaatgatgagttaatgggtgcagcacactaacatgacacatgtatacatatgtaacaaacctgcacattgtgtacatgtaccctaaaacttcaagaataaaaaaaaaagagtttttcaggatgatggtccatcctgaagtacataggaaaaaaaaaaaaaaggaaaccactatggtattccaagttcatacaatgtagaatagaagctggagtgttagtacagaaagcattatctgttcgatagcccggataaacaacttcaggaaagtttcaggatgcaaaatcaatgtgcaagaatcactagcagtcctatataccaacaaaatccaagtcaagagccaaatcaggaacacaatcccattcacaactgccacaaaaaataaaataaaatgtctagaaatacagtttaccagggatgtaaaatatctttacaaggatcactacaaaccactgctcaagaaatcagagatgatacaaacaaatggaaaaaaaatccatgctcatgggtaggaagaatcagtatcattaaaatggttatactgcccaaagcaatttgtagatttcatgctattcttatcaaactgtcaatgacatttttcaaagaattagaaaaatgtattttaaaattcatatggaaccaaaaataaaaagcccaaatagccaaggcaattgtaagcaaaaagaatgaagctggaggtatcatattacctgatttcaaactatgctacagggccacagtaaccaaaacagcatgatactagtataaaaacagatacgtggatcaatgggacagaatagagaactcagaaataaggtcgcatacctacaactgtctgatctttaacaaagctgacaaaaaaaatggggaaaggacaccctatttaataaatggtgttgggataactggctagccctacgcagaagattgaaactggaccccttccttacacaatatacaaaaattaactcaagatggactaaagacttaaatgtaaaactcaacactataaaaaccgtggaagacaacctaggcaataccattttgtgcataggaacttgtaaagatttcatgataaaaacaccaaaagcaactgcaacaaaagaaaataaaaatgacaaacagtatctaagtaaacttaagagtttctgcatagcaaaataaaatattaacagagtaaacaaacatactaaagaatgggagaaaatttttgcaaactatgcatctgacaaaggtctaatatctagcatctacaaggaactaaaacacattttcaagaaaaaaaacattaaaaagtgagcaaaggtcatgaacagacacttttcaaaggaagtcatacatgcaaccaacaatcacatgaaaaaaagctcaacataactgatcattagatgtagatgatgggttgatgggtgcagcaaaccatcacagcacgtatatacctacgtaacaaaccggcatgttcttcacatgtgtcccagaacttgaagtataataaaaaagttaattaattaaaaaaagaaaaatgtaaatcaaaaccacaatgagataccatctcacaccagagtggctgttcttaaaaagtcaaaaaattaccgatgttgatgaagtcgtggaggaaaggaaacacttgtacactctaagagtgtaaattagttcaatcaagaccagactaaatatagatatgcatccagaaatgcttttagaaaatatatcatatgtttataatacataagctaataaaatgggagagttctctgattcccctggcaggatgtgtgacaggggtgtggctcacctgtttggtcacccggcagctcaaacccctaaggcagatgggcaggtgcagaggccaggcaggtgcagaggccagggcagagcgttttggactctcagccccatggcagcgtctagggctgggtgcctacaaccacagtgttactaagctctgtcagctttgccatctgcaggcggcttgtgtgttagttagcccaataaaccctctgccttatctcaagggcagaaggccagtgtgacagtcttatgtatcctgagttcttgcccagtgtcccaaaagaatcggatcacacgtgagcgtgaaggattgaatgcaaggttttgttgttgttgttgttgttttctttcgttttgtttttgttttttagagacggagcctcactctgtagcccaagctggagtgcagtggcgccgtcttggctcactgcaaccttcacctctggggctcaagagtgaatgcaaggttttattgagtggtgcaggtggctctcagcgagatggataggtagcagaaggagggatagactgggaaggtggtcttcccctgcagtcgggctgcccagaggcaggactctgctctgaccgccgccagctccccaccaccccacctctccgctgaactatcctaagcatctagagaggtccctcctcttctctatttctctgccacatcgttctgccgttgctagtctgcttgtcggctggtcgtctggccttgatgttcagctgcttgtgtgtgtgcctgctaaggtctcaggtttatgtgggcacagaatggggggcgtggtaagccagagaggtcttggaaaatgcaacattcaggctcaaaaacaggagtgcctgttctcaattaggtctgtgggcacatgcccgagggtgaatccctcaccagtgaccttgctcttctctaccccacacttcgctgcccaatctccagttccactaatatatctaaaagtcacatgggatccctccagtctagattattggtgagactactgaaagcttcaggtacaactttaacatctgcttaccttgtttttttttctcttaaacagctttagtaatgtataattgatgtactataaattctacctatttaaagtgtacagttgataagttttgacatgtaaacattcatgaaaccattactacaatcaagataataatagatcaattgccgcaacagttttatcatgttcctttgtaattgtcttatacttctccccagtctcctatagccaggtaaccattcatctgttttctgttaatagagctttgcttgcatgttatagagtttcatataaatggaaccacagtctgtatacttgtttcactagcatctttcactcagcatcattatttttattttgagatttatttactcttcatgtaccaatggttcattccttcatagtgcggagaaatacctcattgtatagatatgctacaatttttttattcattctctgttgatggacatttaaattgtttccaatttgaggtcattgcaaataaaattacgatgaacatttgtgtaaaatctttaaatggatatgtgttttcatttctcttggctaaatacctagaagtaaattggctagatcacagggtaagtggatgtttaactttttaggaaactatcaaactgttttccaaactgattttaccattttatttccaccagcagcgatggagagttctggttgctttatattcttgccaacatttgatatgacctgtctctttaatttcagcctttctaatatgtgcatagtacttcattctggttttagattgcctttccctaataactaataataataagcatcttttcatgtatttactgaccatctgtatcttctttggtgacatgtcttatccaacattttaattactttgttttattatttatcgagttttaagagttatttatatgtgttctatgtatcttttagcagatatatgttttgtaaaatattttttatttcaatagctttcggggtacaagtggtttttggttatatgtattaattgtatattagttaattctgagattttattgcaaccatcacccaagtagtgcatgttgaacccaataggtagtatttatcccacaccccattcctaccctctcctttctgagtctctaaagcccattatattactttatatacctttccgtactcacagcttagctctcacttacaagcgagaacatacgttgtttggctttccattcctgagtgatttcacttggaataatggcctccagctccatttaagttgccgcaaaagacattattttgttccttctcatggctgagtagtatttaatgatttatatatacacctcattttatttatctactctttggtcagtgtagacttaggttagttccatatctttacaattgttaattggattgcaataaacatatgtgtgcatgttttttttttcttcatataatgactctttttttggtggggggatagatacacagtaatggcattgctgtattgaatggtagatctacttttcatttctttttttttgagatggagttttgttcttattgcccaggctgaggtgcagtggcgtgatctcggatcactgcaacctccgcctcccagattcaaaagattctcctgcctcagcctcccaagtagctgggattgtaggtgcccacctccatgctcagctaattttttgtactctttttagtagagatagagtttcactatgttaaccaggctggtctcaaacgcctgagctcgtgatccacttgcctcagcctcccaatgttctgggattacaggtgtgagccaccgtgcctggcctcaacagtgttttatagttctccttgtacggacattttatcttcctggttaagtatgttcttaggtattatatttttttgcagttaaaaaagtgatggaatttttaaatttgattctcagcttggatgttattgctgtataactgtgctactgatttgtgtatattgattttgtaacctgagatgtaactaaatttgtttatcaaatctaggagtcttttgaagaaatctttagagttttctaggtatacaatcatatcataagtgaacagtgatagtttgacttcatctttttcaacttggatgtctttcatttcttttttttcccctgattgctctgactaggacttccagttctatattgaatagaagtgataaaagtgggcatccttgtcttgttccagttctcagagggaatttcagcatttccccattgagtataatgttggctgtgagtttgtcctatatggcttttattactttgaggtaagtcccttctatgcctaatttgttgaaggtatttattataaagcattgctgcatattatcaaatactttttctgcatccattgagatgattatgtggcttttgtttttaaatctgtttatgtgatgtattccatttattgacttgcatatgttaaaacatccctgtatccctgggatgaaactcacttgaccaggatgtattatctttttgaggtgctattggagtcagttagctagtattttgttgagaatttttgcatctctgttcatcagggatattagtctgtagatttttttgttttttgttatgtcatttattagtctgtagttttgttgttgttgttatatcattttctagatactggcttcacagaatgatttaggaagaattccctctttctttatttttgggaatcatttcagtgggaataattgatactaattattctctgagtgtgtggtataattcagctctgaattcttctggacctgtatattttgttgttggtggtaatttctttaatttctaattcaatcccactgttactggtctgttcagggtttctacttcttcctgatttaatctagaagggttttatgcttccaggaatttatctatttcctctaaattttttagttgtgtgtgtaacagtgatcatagtagccttgaataattttttggatttctctggtattggttgtaatacctcctgcttcattcctaattaagcttgtttggatattctctcttattttcttggttaatctcactaatggtctattaattttgtttatcttttcaaaaaaccagctttttatttcatttcacttaccttttgtattttttgttgtaatttcatttagttctgctctgatccttcctatttctttctttctgatggctttgggtttagtttgttcttgtttctagtgtttcttgagttgtgacaatatagattgtcaatttgtgctctttcagcctttttgatgtaggcatttaatgctatgaaccttagtcttagcactacttttgctgtttcccagaaattttgatcactctgtcactattatcattcattttaaataatttattaatttccatcttgatttttacccaaaaatcattgaagagcaaattacttagttttcatgtatttatatagctttgagggttctttttggagttgatttccagttttacttcactatggtctaagaagatacttgatatgattttgattttcctgattttacagagaacaattttactgatttatttatcagatctaacaatttttaaatgaaatccttgggtttttctagatattatactatgtcaaatgcaatgaagaataacttgacttatttatttccaatttgaatgcactttattttattattattattttttgctcctaattgcactaacaacatcttctggtattatgttatataagaggactgacagtgggcatctttctcttgttccagtccctaggaaacattctttaatttttttcttgttcagtatgattttagtcatggatcatatatggcctttatcattttggagaatgtttcctctaaagtcattttgatggtttggtgatctaaaaccattataatttattatatagggatttggatttttatgggctttttttagcatgtactgaaataatcctataattcttggatctgttaatacggtgggtcatgtttactgatttgcatgtattgaaacatccttccctcctcccttgcacgaattctgtgttaccctagaaaattatcttcttaatgtattattagtttggtttgcttgtattttttgaggacttttgcatctacacttgtattagtccattttgacactgctaataaagacatacctgagactgggaagaaaaagcggtttaattggacttagagttccacatggctggggaggcctcagaatcataacggaaggtgaaaggcatttcttacatagtggcggcaagagaaaatgatgaagacgtacgagcggaaatctctgataaaatcatcagagctcatgagacttattcaataccacaggaatggtatgggtgaaactgccccgtgattcaaattaactctcaccacgtccctcccacaaaaatgtggaacttttgggagtacaattcaagacgagatttgggtggggacacagagccaaaccgtataattctacccctggcccctccaaatctcatgtcctcacatttcaaaacctatcatgccttccccaatattcctcaaagtcttaaatcatttcagcattaacccaaaagtccacagttcaaagtcttatctgaggcaagacaagtcccttccacatatgagcctgtaaaatcaaaagcaagctagttacttcctagatacaatggggttactgatattgggtaaatatagccattccaaatgggagaaattggccaaaataaaggggttacaggacccattcaagtccaaaatccaccagggcagtaaaaatttaaagttccaaaatgatatcctttgactccaggtctcatatccaggtcatgctgatgcaagaggaggattccaatggtcttgggcagttcagtccctgtggccttgcagggtacagcctccaccctggctgctttcatgggctggcaatgagtgtctatggcttttccagttgcatggtccaagatgtttgtgcatgtatcattctggggtctggaggatggtggccttcttcttgctgctccaataagcagtgccctggtggggactctctgtgggggctcacagcacacattttcctttcacactgccttagcagagtttttccatgatggtctcacccctgtagcaaacttctgcctggacattcaggagtttccgtacatcttctaaaatcaaggtggaggttcccaaaccccaatttttgacatccatgtactgcaggctccataccatgtggaagctgccaaggtttgaggcttccaccctctgaagccatggtctgagttctacattggcccatttcagccacggctggagtggctgagatgaaaggcaccaagtctctagactgcacacagcatgtggaccctgagccctgcctaggaaaccatttttttctcctagacctctgggtctgtgatgggagaggctgctgcaaaggtctctgacattcctggaagacattttccccattgtcttgaggattaacattcagcttttcattactaatgcaaatacatgcagccagtttgaatttctcctcagaaaataagattttcttttctattgcattattaggctgcaaattttccaaacttttatgctctgctttcctttcaaaaaggaatgcatttaacagcacccaagtcacctcttgaatgctttgctgcttagaaatttcttctgtcagataccctaaatcatctctctcaagttcaaagtttcacaaatctctagcccggggcaaaatgccacccgtctctttactaaaacataacaagaatcacctctgctctagttcctaacaagttcctcatctctatctaagacaacctgagcctggatttcattgtccataccatttccaatacttttgtcaaagtcattcaacaagtctctatgaaattccaaactttctctcatttttctgtcttcttctgagccctccaaactgttccaatctttgcctattacccagttccaaagtcgcttctacatttttgggtatcttttcagcaatgccccaccctactagtaccaatttactctatttttctgttttcacactgttgataaagacaaaccagatactgtgaagaaaaagaggcttggccaggcgtggtgactcacacctgtaatcccagcactttgggaggccaagacgtgcagatcatgaggtcaggagattgaaaccatcctggctaacacggtgaaaccccatctctactcaaaatacaaaaaattagccagacgccttggtgggcacctgtagtcccagctactcgggaggctgaggcaggagaatgccatgaacccggggggcagagtttgcagtgagccgtgatcgcgccactgcactccaacctgggggacagagcgagactctgtctcaaaaaaaaaaaaaaaagaaaagaaagaaaaggaggcttaattagacttaaagttcctcatggctggggaggcctcagaatcagagcaggaggtgaatggcacttcttacatggtagcagcaacagaaaatgtggaagatgcaaaagtggaaaccccagataaaaccatcagatctcatgagactcattcactataatgagaacagtatggaagaaacagtccccgtgattcaaattaactcccatagggtccctcacacaacacatggaaattatgggagtacaattcaagatgatatttgggtggggacacagagccaaaccatatcaatactcatcagtgatactggcttgtagttttattgttttgttatgcccatgctttgtttttgtgtaagagtaacattatcctcatagaatgagtttgaattattcccttttttttttatttctctttttcttttcttttttttttttgaaaaggttgagtcagattggtatcaagctgttacatgttgggtataattcaaaagtgggatcataagtttctgaacctttttattttgatgaaagacattttattacttcaataacagcttcaatcccttgcccattattatttgtttgatgttttcaaccgctttatagttcaatcttagtaagttttgagtccagaaattcatatatttcttctaggtttactattaatttatcataacaattctaatagttttgtattattttggtctcagtttttatgtctcttctttttccatttctgatggtttttatttgcatcttgtctatgtttttcttgcttaacttagctaaaggtttgttaacatcattgatctttgaaacaagtcagggtcactggtctggttgtctaaggtgttatcagagcttgtgatctcaggaccaaaaaaattaagaagcgtggttacaaagggtgaggttggagcaaaaatttaataacaaaaaaacaaagctctcggcagtggagagggttccctgatggttgctgtgttacggttgtattcaaaagctcttatgaggaactgctttcatctctgtaactgagtaacttttcttatctataaaactgcctgcatagtttcatctctgtaactgagtaacttttcttatctataaaaccgcctgcatatctcccagttattctctgtcattgtggatatgtctccaggaaagcacaaagtgctgtttcttgcgtttgtataatgatgggtttgttttaggtacacccccctcctctctttgcaaattcccatggagcccactgtgtacatgtctgaaaaggggaggacactttttcctgggagcttactaatcatacaaagagcaaagggtttctatgctggacattgcatgccttgcctgcttatctgtggcttatctgtgcaggtgcactgtagctgtgattttttttttaggcaggcagcttctgcagtctgagtttttccccaagctgctctatttttcctgtagttgtgagttttcaggaaggcagcatttttgaggaccagccttaattgtttacttaactgattttctcttttcttctccatcatcttcacaaaaaaacaactttttgtttcatagatcttttgtattgtgtttattttagcctcaaatttatttaactgtgttctggtctttataatttctttctttctattagctttgggtttggtttgttcctgcttttttagttctttgatgtataggattaggttatttgaagtctttcaacttttttgatacagatgtttgttacaagaaactttcttcttacagtttttttggccatcttccatagatgttggtatgctgtacttccattttcatttgtctcacaaaatttttaaattttcttcttaataacttcattgacatgtttgtcatttagcagtatgtttaatttccatgtgttcatgtctgttttccagattcttcttttaatttattttttgttttatttcattgtggtcagaaaatatacttcatatgatacttgtgtttttgaatttgtacaggcttgtttggtagcctatcatagaattaagggagacattttttgtgctaataaaaagaatgtctattctacagcaattatgtgaaactttctgtatatgtcagttaggcccttcatatctagtgtgtactttaactctgatgtttctgtgttgattttcttcctggataatctttccattacagagaatggggtgttaaagtctcctactattgctgtgttgcatgctagttttgcctttaggtctgttaatgtttgctttacatgcttgagagctcaggttttggtaagtataatgactaaatcttgctaaactgaccccttcattatcatgtagttactgtctttgttttttgttttttttttcccgtctgatttgtaatctgtttataactacacctgtacttttctggtttctagttgcatggaatatattttgccatcccttcactttcagtctatgtatggctttataagtgaagtgggtttctttaaggcagcatgattctttattcagccattctatgtcttttaactgagaactgagacaatttacatccatttttattattgacaagtaaggcttactagagccattttgttgattgtttactgtttgtttttagactcctctcttccttccttcctgtctttcttcataattaggtgattgtctctggtagtatatttcaagttgctgctttttaagtacatcaatgatagatttcttaactgtggttaccagtagacttacagaaaaccattttagagatatggcatgttattttaaagagatcacaacttagattgcaaataaaattataaaataaataagggcaaaagtcacagaaaatgtatatactttaactcaatcacctacccattttgactcatagttatcttgatttacatatttgtatatcatctgtttcttaaccggttgctatagttgttatgttttctgggataggtgaaatgcagaacacaaattcagtactagcttattctgggtttttgcatgtactcaattttaccacttgtttttataccttgaaaagttactttttgcatgatagtgttttactctttctgactgaagagctcccattagcattttttgcaagatgggtctggtggtggagtctcaggacttttccttagttcagctaaagatgggatccttgtctgtcccatggccacaaaaatttaggctcacagatggtttgaatgtcgaggactctgaaaggccagagtccccctgctagagtgcttcctgctcaaagcttgaatcccagcttccacacagaaagaggaggggcctggctcttccccactgcaaatggcacaaacttgctgaggttccaccccagtgaacatttttctcagtgttcaagctctttggagattctctggggaccacctcctacctggctgtctctttcccccttgtaaagaagtacatctgaatgctatttgaaagagcataaggaagatcaatctttactgcttcctgctgacaaggggtgctgtttttgggaaatggtggtcagagctcactcacaggcctatctaagagttcccccagcagaaagggccattgtcagagactctgcttgcattattgtttggagtttgatgccctgaaggcaagaacagacaaactaggttattagaaaacatgtatcaaaatgaaacaaggggaggagtaaggatagctcaaaaattctgaggccttttatcactttgcacagggagagaaaggccaaaagccagactggtaaaatacccttttgctggcatgttggtcttctgggttcccttcttctgggcccaatctttagccaaccagcttaaggtttggaaagttaactctttccagtttggaagatgcatctgaggggaatgtcccagaatacggagacataattacctatccgtgaagagagaacagaggagaagaaaggaaaaagaaggcaccttttaaagaagtcccagggggtcatgatgcattcaaaatgggtacagactgaaggtgaatggctactcacctaggaagagggtggcaggtgtccctagttctcttctctttctagcagatacctggggtacatgagggagaaagagcatcctcttttcttcttccgtccttgcttccccgagtgctggtaaccttggtatgtgctgaaacaggtgtcaaagcaacatgcacccatgaaccagtggggcctagggggtgagaacattcactcttacccacttacccacatacaccctatctcccctgctttcagtagtctgggagtccctagacctcatctatgccatggatactaacaaggcttttatccatgaaccagggagcttgggcttcacttaattggcaggaaacagccacactcacctgcactgtgcattttgttgcacaaagtaggggcttatcctgccttagggactgactctttttcaggtttgatatctgcatgttttccttggcctggctcttataaaaccccacccaggaactgggttttctcctgcctgtctgcgtgtgtgttatgtgtaatgtctgcagaaagagctctaaatgattttggcctgaaaaagacaaacacttgcatctaatattttttaaagagaagttaaaaactgtggtaccgttcagttcacgtgactttaatctttgagaaataggaagaggcttaaagattaatggtaaaaagcagatgtcattacagtgtaaataggtggactaaataacgcaatggtgtctttgtccatctcagggccatgaaaatttaggctggcagatggttcaacaggtgagtaaagcagggttttattgggtgaaaaggaaaaaaaaaggggaaacagggatcttccacaaggctggagacccctgccagagtgcttcccactagcagcttgaatcccaggttccacatgggatatttgccgggctcctccctgttgcaaacagtgcaaaattcctgaggttccaccccagtgcacattcctcccagtgcacaggcttgttggagattctctggggacctccttctcctctgactagctcagtggtcaattctatgttttgtttgcctggtaaatacttcatctctcatttatatttgattgataattatttttgtttcaatattttttggtggcatccttttgtgttgagcactttgaaaacatcattccagtccttcctggtctgtatagtttcttttgggaagtctatctccataaatattggcgctgttttatatgttatttgctttcacttgctgatttcaatcttttttctttaatgtatttttttttgtcctttgtgactttgattattttgttaattggggtagtcttatttgggtttgcattgtgttctaagacctttctgtacctggacattttatgtttctcaagttttgaaaagttttttgttactatttttttgaatgagcgttctacccttgctcttactcacatctctcttgaacaccaataattcttagactgggtcttttgaagtaattttctatattttgtaggtggcacttgcttttttattctctcttgactttttaaaaataaaataacgagtcttagagctcacagattcttttctgggcttggatcattctgtggtttaagacctctaatggattttgaattcagcaaatgcatttcttagttccaagatttctgattgatttctttgtattattttaacctttttgttaaatttctcggataaatttctgaaataacttcctgtgttaacttagacattactaagttttcttaaaactgctattttgtattctgggtcagagagctcagaaattgggttatcttattagtgtcaatcactagatttttgcattgtccttttggagaggtcctggttccctgttctctgttgtttcttgtgaatatatgcatgcctttgcattgaaggattatttgttccattttttttctgtctttttttaatggaatatatttgcttagaaaatctttaccgaaaagtcactgcattcactttagttctaggtgacatgttaagcccaggtttacctcagctcatgtgaatgattagagctctgcctgtcccaagtgatgggggttccaaatggattatcctggaagtgtgagaacactgcctaagggcttgttcccagtatacctaaagaacttacatcctacagcatgctgttgctaagcaactactctgatttgaggtcaatttttggctgagttacggagaagagtttccatgtctaagaggttggtagtcctgcctctcttttttgtctctgcctgtcctcaggaatgtttctcccttcatgcactcataacatttccactgggttaaggaaagacaggtctaccagggaacttgataagatggggaagcttagtgaccatatcagtttgtctttctctcatttatataaaaattacttgacattgagtaatttataaagtaaagaggcttaattgcctcacattctgtatgctatacaggaagcatagtggcttctacctctcaggaggcctcaggaagcttgcaatcatagtggaaggcaaaagggcagtcaacacctcatatggccagagcaagaggaagggagttgtaggaggtgctacacacttttaaacaaacagatctcttgagaatgctgttacaagaacagcaccaaagggatagtgctgaatcattcatgaaagatccacctgatgatccaatcacctcccagaaaacccatctccaacactggtgattacaactgaaaatgagatttgggtggggacacagatccaaatcatattgtaaatcatgaattggagatagatattctgcgtttttggtgcagagcagagttgcaagttaggggcattattaatgtagacatagacatataattcccctacgtagtgtctactcagactttttctacttttatgacactgggaaatgtgttatcctcttaattaagcttttggttgttgtggtgtagatctcagtgccatatgtttgttttgttttgttttgcatgaagaaaaaaaggctgcttgtctctactctgccattttggaaccagaagtctcttgctccgtatattcttaataaacgtttcttatcagatatatgaattagaactttttaaattctacttatcatcagtacacttttttgatggtgtcctttcaagaacaaacatattcatttataagaatatcagtttatccattttaacttagttttttgtgactttgttgccttgtcctagaaaccattgccaaattgaagatagaaaagatttactttttctattctgggttttgtacttctgtttgttaactttgggttgttgatgtattttaaattagttctttatgtgttgtcagagaaagtgtatcttgtttttttggcctttggataatcagtctcccagaagtatttgtggaaaatattgttgttttcctattcaatagtttgacgtctttctcaaaaattaagtcaccactgtgtaaaaggatttctggattctaaaatctgttccatttatttatatggtgatctgtgttcctgtgtcacactcttataactattgatgatatgttgttggttgaaaatcggaaatgcaaggactaaattatttttcaaaatattactggttattgagattgtgccactgcactccagcctggccacagagcaagactctgtctcaaaaaaattatacatatatatatatatatatatatatatatatatatattgtgtgtgtgtatatatatatagtgtgtatatatatagtgtgtatatatatagtatatatacacacacacacgtatgtgtatgtgtgtatatatatatatatatctcgctattttttggtctcctgtatatctatattaatttagaatgagcatgtttatttctgtaaagaacccagctgggaatttaatatggattttggttaatttgtttattaattaagattttcaattgaggaatatgagattttatttattcattaagaattttattcctcaatatttagtaacttttacaatttaagttttaagtttcgcaatttattttatttttttgagatggagtctcattctgtcacccaggttggagtataatggtgccatctcagctcactacaacctccacctcccaggttcaagtgattctcctgcttcagcctcccaagtagctgggattacaggctcacgccaccacgcctggctaattttttatatctttagtagagctggggcttcaccatgttggccaggctggtctcgaacttctgacctcatggtctgcccgcctcggcctcccaaagtgctgggactacaggcatgagccactgcacctggcctaagttttgcaattcttttaatgtttttcctgtttttttaaaataatttttgattatattttatgtaggatttttgaacatgttattttcttctgtattgttcaattatgtaacaatacaattaatatttgaaggttgaccgttagtcctaaaaatgtgcttattttgttgttgatctaatattttctaggaaagtctaagatattctttacataaggtcatgccttttgtcaacaaagagagtgtacttatttcttaccttctaataaggattatttttgttttgtgttacttcctatttgctttggctggaatctccaatataatgttgaatagaagtaataagaatgaatgtctagtcttttccttattttagaaaaaaatgagttaatcttcataataggtgtctccagacaaaaagagccatgtatgaatacacacacattagtacacacctatgagggaggattttattgtaggaatttgcttaggctgagaaatattatgatatacacttacacactttatatttaggaaagctgatgctgtaattcaatctgagactgaaggccttagaactaggagaaatagttgtgtaattatttgtctgaggatgatggccttagaacttaaggagctacaagtggggtttactagtgcaaaccctagtgtccaatggcccaatatccagaagcctcaaataaagaaggcagaataatattaatgtcccagccaaagaaaagagaaatatttgtcttcttctgccttttgctctatttgggttcttaacggattggatgatacctgcccacaatcatgagagatatctttagtcagtctactgatttaaatactaatctctttttaaagtattgtaacgtttgtcacagaatcataaaaatatctatcctaaaattcatacaaaccccaaaatagccaaataaatcataaactaaaagaagaaagccagaggcatcaaattacctaatttcaaaggatattaaaagcctgtagtaactaaaacagcatggtagtagtacaaaaacagagacatagagcaatggaacagaatagagaaccaaataataaagccacacacctactgccacctgatttttaatgaagtcaggaataacaagcaatgaagaaagaaccctctattcaataaatgatgctgtgataattgtatagtcatatgcagaagactgaaatttgacctcttcctttcaccacatacagatatcaactcaaggtgtattaaatacttaaatgtaaaatctaagactatataaatatgagaagaaaacctcagaaataccatcctggatacaagccctggccaaagttttatgacaattaccccaaaaggaaattgtaacaaaaaaaaaattgacaagtgagacctaattaaactaaagaacttgtgcacagaaaaacattcaataacataaacagataacctacagaataggagaaaacatttcaatactatgcatccaacaaaggactaatgtttagaatctagaaggaacttaaacaaattaacaagcaaaaaagaaaaatcccactaaagagtggccaaaagagaacagacacttctcaagaataagtacacatggccaacaagcatatgaaaaaatactcaacattactaatcatcagagaaaagaaaatcataaaaaccactataagataccatcccccctagtcagaatgaatatcattaaaaagcacaaaatgacaggtgttggcaagattagggagaaaagaggatgctcatacactgttcgtgggaatgtaaattagttcagccactgtagaaagcagtttgaagatttttcaaataacctaaaatagaattaccattttacccatcaatcgcattactgggtatatacccaaaggactgtaagttgttctaccagaaagacacatgcacacctacgtttatcaacagcatcacagtactattcataatagcaaaaacatggaatcaatctatatgcccaacaatggtggcctggataaagaaaatatggtacacatataaatgatggaatactatgcagcaatgaaaaaaaaacaaaatcatgtctcttgagcaacacagatgcagctggaattcattaccctaggcaaattaccaccagaaaggaaaaccaaataccacatattctcagttgtaagtgggaactaaacattgagtacctatggacaaagagaaaggaataataggcaatgggaaatatgtgaaagtgtagaatgagagatctatgagaatcaaaaaactacctaccaggtactgtattaactatcttggtgatgaaataatttttacacaaaaaccctgtgacatgaaatttactcatgaagaagttgacactttaaccttctgaacctaaagtaaaatttagaggaggaaaaatgaaatgctctcacagataaatccagaaataattttttttttttttagctatttggtaatctcttaaaccagtcaagttgacacataaaattaaccatcatagttgtgcaattattttttgtggcatttatattgtgcaatatattttatggcattttcagtgcaattgtattattttatattggataattagaattatgtaaatatattgatttttatatatcaatcttttatcctgacaaggttatttatttgtttttgatctaatattttatactagatttattaagatattctctatgtaaagttgtatcatgtactgacatatgtaattgtattaacttctttttcaatatgcatgtttcttattttctgtcattgtctaattgccttagcttaaatatacaatggaatattgtcctaaaatgataaatagatctcttcatcttgttttttatcttaggtagtatttcactgatacacataataatagttttagacttttcatagctgtcttttatcagtttcatgacatttaacatcattctggttttattgaatatttttattttttattttaagtctatttctattttcagtttctgtcaattgcatatcatagttagtgtcttttgagagatttgctcattttattgagttatatgatttgttggtatgcatttgctcctagcaatgtactgtaatattttgtatttctgtatagtgtgtagtaatgtgtagtctttcatatctgattttaataatgggagtcttctcttttatgagaggtaagtctacataaatactctttgttttatttaattttgttaatcttttgaatgtaccaaattttggttttatttcctttgttgtttttattctttcatttgcttattttagcaataatcactatttcttttcttctgctttggggggtttgttcattttttctagttccttaaagtataaaattgcatattaattaaaaatttttgtctaattaatgtaggcattttaaggtcataaattgtcctctaaatattgctttttaataaattttggtgtatttgtttttaatattcttaaactttgttctgttttcttttgattttatctttgttattttgaattatgttgtttaatgtgtaatcatttgtgaatttctcaattttttaaaactgctgacattgaaggttattcctttgtattttcagaaaataacacatactatttcaatcctcttaaacttattgaggcttttccggtcaagtgatgatttgttttggaaatattaatatgcacttgataatattaaatatgtagctgctttttggagtgtgttatagttgtgtgttagagctagaagatttatagtgttcttctagtattctatttccttgttgatctttttttaaatttttgtgtatttttaagagtgaaatagagggggtgggccaagatggctgattagaagcagcagtggtccatggctctcatggagaagaatgaaaacagtgaataaattctgcaacttcaactgaggaattaaggttctcaaattgggactgacttagcagttggcacaactcagagagtgagaaaaagcggagtgggatgacagcccaccccagagtgccacaagccaggggagtccctacccccagccaaaggaggtatctctactggtgatacctccaggtgtgtgagagaccgaggctgttgctgtcagttgctatgggattgggtgaagggggatgaatggagaaatgaagacaaagacaaaaagatctgttttaaaagaaggtgtcaggggctccttgcttctagtgaacaaaggctttgagcttctacagcccttcatatttattaggtgaaaagagcagggaggaagaggtaatggttggtcagctgcttgatttatcacaggtacacataatttctttctttgtacaacaggcttcagatattcctacagataatcacaaggaacactgtgcttggggtgtgattgccctcagcactccttctgggggcagacatagtcatcagttttccaacatcctgctttcatgagaacagttttctgtttgctcatatagcctccagtggtatgctgagttggtcacgaccctcattcttttggcctgtaacatctccctctttttgttttttcattaattgaataaaggtaattgcaggttctgcagctctcaattgccatttggtggtccacctgattttgaagactatgaacaaaaaacagaaacataataacattaatccaatagtaacaacaaagacattgagttgctgtttgcggtaggtccaagggttaaggctctctaaaccttgttggaattctgcccaagcttttaaacagggctgaaacacttgagtttgcttatcgaagttaaggattttactttgtaaatcattaatatcaaaagtaacattggatgtgaaagctccctgtaaatgggcctttacaaggctccaggaatattcactttggttatattccaaattggtcacacaaatatgagtatgattaaaatgacaatgcaattgctgatgcaactgcaaactttgttatttgttctcctagccaaagaacagtagcctttaacattgccacctctgttcatatttcagcgttaattttattttgaagcatccatgcctggccagctgtgcgtgtccaattttctacatattgagctgtttgaatagagcgatgcattgctactgaggacatcacaacagaggttatcaatgtaactaaggagactatagcaacaattatcatgcctaaggctctacgagcacgatgagtaagctgagtaaaaaagagttttataagatgtaaaatgggggtggccacccaaggttcagacagatttacaggaatccataatctgggaatgcaacctagaattattagggtggatatatcatgtgtctgtattgtgctttgattaaggcaatgataaagttgacaggaatcacaagtcgactgggcatcatccacctggagttggtccttttttgctactaagaaaacgtaagaattaaagcacaaattataaattgagtggtaatattttctaccatgatcatattaaaactgcatttagcactgttattattattgaataatgtcccaactcaaatgctgccattaataaatgggagtgctgttttgcatatcgaattctggattggacctctctttccttgagaatgccattgaggcaaaggtgggctaaggcctgcgccatgccaagtaatttgcgcagcagattcggattgaatcccaatgtgacgtggcaaagagatgttaaagttttgccaccagtggcagtgaagttcatgccatgaggtctgatgctcatctctcccaaccaagtgaccatggggaccccagtcaataatgtctcccatcagcatggactgttgtctagctagggagccaagacactgggtccaaggaggggagttagaattatcaaagggaacccattctgtataattaatacaatttgggcgatgagaccaggagtgattagtaactgcactagaaatattaatagagctgaggcccaataggcacaaatattttcttttttttactattatactttacgttctagggtacatttgcacaacgtgcaggtttgttacatatgtatacatgtgccatgttggtgagctgcacccattaactcatcatttacattaggtatatctcctaatgctttccttcccccctccccccaccccatgacaggccccagtgtgtgatgttccccttcctgtgtccaagtgttctcattgttcaattcccacctatgagtgagaacatgaggtgtctggttttttgtccttgcgacagtttgctgagaatgatggtttccagcctcatccatgtccttataaaagacatgaactcatccctttttatggctgcatagtattccatggtgtatatgtgccacattttcttaatccagtctatcattgatggacatttggggtggttccaagtctttgctatcgtgaatagtgttgcaataaacatacgtgtgcatgtgaggaaagacaattttgaaaccaaagtttgattttggaaagcctttttagtatatttaaagcatttgatattgtaaaacagaattccaaattactataagtcatttattttgccaaaatgatgactcagaaacgttaaagaagcaaaaaccttttataactcttttgaatttagttaatatattcacatagataacctattctgcaagattaattttcagaatttttctaccacttgtttgaaacttcagctttttcctaatttgaaaagccaggtgtcaggaaagacaattttttaaattatactttaaattctagggtacatgtgcacaatgtgcaggtttgttacatttgtatacatggttgcgtggcacatatattttctatggtaactcaatcatgcctgggattaaattgcaaggaaactgcagttgagtgatgtatcctgggtgatgcataaaggaagtccctccaatggagcagtataattgataccattgtcctgagagtctaattgctctgtgtcagggggagttaagggtcctggtgcccatactccttgatcatgatataactcaggaggattgccagtccagagtaccggtcatactactgggaggttaagaacatatgcccaatatgtttttgcctctgcacagggaaaacatactgcacaggatattacagctgacatggccataaacttggagttaggggtttttgcctcaccctgatgctctagcagtttctcagctttttgtgtggttttcttgatctgtccccatgtctttgcattcagattcaactggctcatggctcatattggaggagctgggcccatggttgggatccatgggtccctccagtctcccattccatggtcacatacatggtgggggaacccacacagtttgtccatgtcctgtaaaaacataagcataccctcatccccacgttagtaaatctactgggcctttccattgcccttcttctggggacttctataatacctttaggtaaacttttttccctttaacatttgccactgtcattctgccggagtcttattatctgtaacaggagctaaaaaatttaaagtaaataaggctaaatgtaattttatttgaggtggtagctggtctcctactccccctttttgtttttttcaacatacactgtatgttagttacatcaattacattaataaatgtaatgcatgtttgatgtgccagctctataatgccttgtcctcagggattgtaaggaattcctgtcttatgagtaatttcccataactataaaaaattttgaaaagcatgactaacataagcaggtccattgtcagattttattggtttaggaacacccatatgggcgaatgacaataaacaatgccgctgtacatggccagctctttctgtttgacacgtagcatgtaacatatgagagtaagtgtctacagtcacatgaacacagctaagcttgccaaaggctgctatatgtgtaatacccatttgccagatttcatttggagctaagcctcgtgggttacatccttttatgggtatatcaccagggacatactggcaagtgggacaggcttgcacaatagctcgagcctggctacgaggcagatgaaacatacaagtaagggtgaggtgttttgatgcaataatgtatgaaaggcttgagcttgctgaaacacagagtcaatcaatttatctgctttgtcattgcctacagatagtggtccaggaagttgtgcgtgagagtgaatatgagaaatatgtaaaggagcagcataagaatgaataacttgctgaagtcttagaaacaagttaaacagctctggttctagggtgcttttaatagtggcagtctcaatgtgactggctacatttacaacataggctgaatcacagacaacgttaataggagttgaagcagtgagctgtaaaacctcaataactgccattaattctgagtgttgagctgaaactccagaggtttttattgtttgagtatgcttaggtccataaatagctgctcagcctttggaagagccatcagtgaaataagtctggccacctggaataggcttgtgataagtaatcacagggaggataaaagggtgaactttacaaaattgcaaaacttgcctgatggatagtggttgtctattattactacaaaatccacaagagcaatttgccaagcagtcaacatttcccatgctgcagcctgttgttggaaatccaagggaacaataattttgtctgggtcatatcctgtaaacatttttgatctatgcctatccatagttataagttgagtaattaaagaaagataaacttgtaaagattttactgtttgattggatagaaaaagccattctattaccattacaaacttgtctataaatgggcccaaaattcctattggagagtagggggttggaagaataaacagaagcaaaggcttttgtggctgtagccaggaggcatgtcttcactgaagcatttgttctacaagctgtaattcagcttctgcctccttagtaagttgccaaggagagtctaatgaagaatctccttggagggtctgataaaggtgtttgagtcgataagtagcaatacctatcatcaggcgcagccaattaatatcccctaacaattgttggaaatctttcagtgtttgtaatctgtccctacggagagttactttctgaagtcgaacacttctttcagtaacaatagtgcttaagtaccgatgtggggaggttgtttgcaccttttctggagctattttgagattccatttaatcaaagcctgttttgtttctctgaataactgatgtaaaatttgatctgtaggagtggccaaaagaatatcctccatataatgaacgatgtaagcagtaggaaacatattccgaggctcctttaatgcctgtcctacaaaatgctgacatagcacaggactgttaagcatgctttgtggtaaaactttccattgataatgagaaccaggttgtctttgatggatagaaagcacagagaaggcaaatcgaggcttatccttctcgtggaagggtatagtacagaaataatctttaagatctattactaagagaggccagtccattaaaatggctgccgcggatgccagaccttgctgtaatgcgcccattggtttaatttgtgcattaatgactcttttggaattgcaaatactggtgaattccagggactaactgactcttcgatatgttctgcatccaattgctcttttactagctgatagagttgagttagtttctcctgtgataggggccattgattcatagaggcatgggtgggacaacagattcttttaaatttttagactcagaacatgactcctgctgtccagcagaataaggagataatggcagacagacagtaagaaacaaactccaagtggagaaatcagaagggtcaactttaagacctttttgatgagctcgttttaatccttctcctattctgttccaaatttccacatcgagagtgcccatctgtggaaaccatgggttatgtacagtgaccttcttcagcatcttagttaatgtttgagaactaacctgagcaccagattgtttaagtaaaactttaagcaactgcacataatgttgctcctgaatagatagattctgccccatgttaccctgattcagaaaacttcccattcccagtacctctttagggcactaaccttatattagctgccagtagacttgtcccaaggtttcttgctcatctggtcagtttcactttctctgctccagcagaccttctttgctcatgtccctgtcctgggcaccacttgtcactgccagttgctacaggattgaatgaagggggatgaatggagaaatgaagacagagacagaaagatctgttttaaaagaaggtgacagggggctccttgtttctagtgaacaagggatctaagcttctacagcccttcgtatttataaggtagaaataggagggagggagaggtaatggttggtcagctgcttgatttatcacaggtacacttaattgctttctttgtacaacaggcttcagatacttctataggtaatcacaaggaacactgtgcttggggtgtgactgccctcagcactctttctgggggcagacacagtcatcagttttccaaatcctgctttcatgagaacagttttctgtttgctccagtggtatactgagttggtcaggaccctcattctttcagcctgtaacagagggtattagagtctggattgaaccgtagcaaacagcagtagccctatagaaggagggcttgactgttaaaagaaaaacaaacaaatagaaagctacagcaacaacatgaacaaaaaaaaaaaaaacgcccataaaaaacccgttcaaaggtcagcaacctcaacaaagttgagaaagaatcaatgcaaaaacgttgaaaatttaaaaagccagagtgcctcttcttgaaatgattgaaacaactctccagcaagggcacctaacttagccaagtctgagatggctgaatttacaaaagtcagcttcagaaggttggtaataacaaactacactgagctaaaggagcatgttataaaacaagacaaagaagctgagaatcataataaaacaatacagggctggacacagtggctaacacctgcaatccaagcaccttgggaggctgaggcagccagatcctgaggtcaggagattgagatgatcctggccaacatggtgaaaggctgtctctactaaaacacaaaaaattaaccaggtgtggtggtgcacacctgtagtctcagctactcagaaggctgaagcaggggaatcacttgaacccatgaggtggacattgcagtgagctgagatcatgccactacactccagcctggtgacagagcaagactccatctcaagaaaaatttacaggagctcaaacccagaattgctcatttaaagaggaacataaatgacccgatgaagctgagaaacacaacatgagaacttcacgacacaataacaagtattgatagccaaataaaccaagcagaggaacgaatctcagagtgtgcagactatttttctgaaataagacaggcagacaaaaatagaggagaaaagaatgaaaaggaatcaacaaaacctctgagaactatggctctatataaaaatacctatgattgattggggtacctgaaagagatagggatagtggaaccaagtttgaaagcatactttgagatataatccaggagaatgtccccaacttagcaatacagggcaacatttgaattcagaaaatccagagaaccccagcaggatgctccatgagaaaatcaacctcaagacacataatcatcagattctccaaggtcacaatgaaagaaaagtgttaagagcagccagagagaaaggccaggtcacctacaaaggaaagcccatcagactaacaacctgtcattggaaaccctacaaaccacaagatatttgggaccaatattcaacattcttaaagaagagaatttgtaacccagaatttcataaccagacacactaagctgtataagtgaaagggaaatcatattcctttcagacaagcaaatgctgaggaaattcatcaccaccaagcttgcctttcaagaactcctgagggaactactaactattgaaaggaaataccgttaccagtgactacaaaaaacacaccaaggtacacagactagtaacactataaaacaaccatgtaaacaagtctgcaaaatagccatcatgatgacaggatgaaattgacacaatattaaccataaatgtaaatggacttaacgcctcaattaaaaacacagaatggcaagctggataaagagtcaagctccatcagtatgttgtcttcaagagacctatttcacatgaaaagacacacataggctcaaaataaagggatggaggaaaatttaccaagcagaggaaaacagaaaaaaagcagtagttacaatttttgttcctgacaaaacagattttaaaccaacaaatattaaaaaaaagacattacatgatgatgagttttcaattcaacaaaaaagctaattattctaaatatatgtgtacccaataaagaagcatccagattcataaagccagttcttagagacctccaaaatgacttagactcccacacaataatagtggaagattttaacactccactgacaatattagacagatcattgagacagaaaattaacaaagattttcaggacctgaactcagctctggatcaagtagacctaatagatatctagagaactctccaactgaaaacaacagaatatacattcttctcatggctgcacggcacttactctaaaattgatcacattattggaaataaaacactcctcatcaaatgcaaaagaactgaaatcataacaaacagtctcccagaccacaatgcaaataaattataactcaacattaagaaactcaatcaaaatcacaagactatgtggaacttgtacaacatgctcctgaatgactcctgggtaaataataaaattacggcagaaattaggaagttctctgaaactaatgagaacaatgagacaacataccagaatctctcggatgcagcttaagcagtggtaagaggaaaagttagagcactaaatgccccatatcaaaaagctacaaatatctcaagtcaatgacctaacatcacaagtaaaagaactagaggaccaagaggaaaacttcccaaagctagcagaagacaagaaataaccaagatcagagcagaactgaatgagatagagacacacaaaatccttcaaaaaactcaagggattcaggagctgtatttttttttttttttgaataaaagttaacaaaatagaccgcatctgcactaataaagaagaaaacttaaaagaattaaatagacacagtcagaaatgataagggggatatcaccaatgaccccacaaatatacaaacaaccatcagagaatactttaaaaatctttagcacataaactagaaaatctagaagaaatggatacattcctggatgcacacaccctcccaagtctgaaccagggaaacattaaatccctgaataaaccaataataagttcaaaaattgaggcagtaataaatagcctaccaccaccaccaacaacaaaaatcccaggatcagatagacttacagctgaattctaacagagatactatttcttctgaaactattccaaatgatcgtaaaggagggactccaacatcaacaacaacaacaacgacaaaacttcaggccaatatccctgatgaatatcaaagcaaaaatcctctaaaatactgacaaaccaaatccagcaacacatcaataagtttatctatcacaatcaagatgacttcatcctcagaatacaagtttggttcaatgtacaaaaatcaataaatgttattcatcacataaacagatctaaagacaaaaaacacatgattatctcaatagatgcagaaaaggcctttcataaaattcagcatttcttcacattaaaaactctaaattaactaggcattaaaggaacatacctcaaaataataagagccatttatgataaatacacaaccaatatcatactgaatgggcaaaagctggaagcatttcccttgaaaaacagcccaaaaccacagtgccatctctcaccactcctattcaacattttattgaaagttttggtcaggtcaatcagttgtgagaaataaataaaagttattcaatcagaagagtggaagtaaaattatctttgtttgcagataacatgattctttatctagaaatcccattgtttcagtccaaaagcttcttaaactgagaagcaacttcattaatctcagaatacaaaatcaatgttcaaaaattggtagctttcctgtacaccaacaacaggcaagcaaagagccaaatagtaaataaacttccattcacaatagctaccatgaaaataaaatatctaagaattctactagcaagggaagtgaaggacttcttcaagaactacaaaccactgctcaaggaaatcagagaggacaccaacaaatggaaaaacattccttgatcatgggtaggaagaatcaatatcataaaaatggccacactgcccaaagtaatttatagattcaatgctgttctcattgaactaccattgacatgctttacagaattagaaaaaaaaaaaactattttaaaatgtataaggaactaaaaagtcagtagagccaagacaatcctaagcaaatagaataaagctggaggtatcatgctacctgacttcaaactatactacaaagctatagtaaccaaaacagcataatacttgtacaaaaacagacaggtagtccaatggagtagaacagagacctcagaaattacaccacacatctacaaccatctgatctttgacaaaccttgtaaaaacaatcagaaaagggtttactatttaatacatagctctgggagaactggctagttgtatgcagaaaattaaaactggaccacttcctaatactttatatgaaaactaactcaaggtggattaaagaattaaatgtaacaacaaaaactttaaaaaccctaaaagaaaatctaggtaataccattcaagtcttaggaacaagcaaagattttatgatgaaaacaccaaaagcaattacaacaaaagaaaaatggacaaatgggatctaattaaaggtctcctgcacagcaaaataaactatcatcagagtgaacagacaacatatagaaggagagaatatttttcccagttatgcatctgacaaagtacaatttcagttactttgctttatttgaaaatattttccctaaatcaaaatcttatcccttcctgaatatttgcaacattccttatatttctcacttttagaaagtatttatcttctaagtgcctactcctgaacttgttttgcagattgccttgtaattcaggcaagttgtattttgaaaaaaatctcaccagaaatttccatcaaagtagaattaagaaggaaaagatgcatgtgacaaaatagacaaacatgtttttattctattaatggtctgttaacctgcaatgaggtaaatctttcttaaaaggatattcaaacccagtttctgagaaaatattgcctgcagagtgtcaatattgttcaatgtttttattgtcgttgagtgcatgcattacgtgtcacccagattccccttttgggaatatagaaattactttccagctgatgaagtgatgaacaactgacatacctcacctataagctctctctctcagtacaaccctgctgaaagctatctagcatatagtgacctttccaagacagcccatatccaatgcctggtcacatgtaggactctaaaggcccattctccccttttcagtttggaccaactctgaaggcctaacagcttcagagctcccagtgggtgagacaaaagctatgctgagactgcatgtcttagcatgctcagggtgctatatagaaaaataccatacattggctagcttacagacaacaaacatttatttgtcacagttcttgaggctgaaagattcaccatcaagatgctggtattgggcattcctccaagatggcaactcgtcaccatgtcttaatgggggaaagagatgaatgagttattgtgagcatatttttcaaaagaattaattccattaatgaggactctgccttcatgacctaaacacctcctaaatggttctatcagctaatacagtaattttggttattataattataacttatgaattttgggggcattcagacattcagaccattgcactgaattatgtcctaatttgttccactgtccaatcctgcttcctactttttcacagatgttatttccaggaaaactctctaattatctccctcaaaaaatattcagcttagaatctacttcttcaaggcactgagcatttgataatatgtaccaagagaggtcagaaaaaaagaacagacaagaaaatgagattgtagagttggattattcactaccaagtgtaatgagaaccctatcactattggtacagagaacacaaatagcccctggaatgtgacaatttaaatttttcatacattcagtaatggtaaattatgatggaaatcttttgaggggaaaacattagttattaggatatatcacatatttatcaatatgggaacagtagaaattatgatcacaatacaggcaaatgtttttttccacagagttaaggcttgggagaaaataatagaagagtgaggactaataaccatcaaattaaggcaaatggtgaaagccagaaatgtctccttggaagtgttactggaaaaaggggtcttgatacagacatgaagtgaaggttcttggattccacacaggaaggaattcaaggtgagtcacagagtacagtgagaaaagatagtttattaaaagctatgacattacacagtagggcatcctcagaaggcaaggagttgaatgcaacacctttgttttaagtttttcttatatagaagtcttgtatctgtaaagattaattaagctgtatctagtcgtgggtggtcagacaacaggacaaaattgattattctatttattccaagaaaactatccttgacactttcctgtgtgaaaatatcaaaacatgactgttattatcttgaaagcatatatcgttatgaatattgggacatctggactcttcattgcagatgtgtgtgtttatagggagctgaacttaaaatcacattactctgactctcctacactcctgattccctaactgcagcatatacagagactctcacttcatgcagaagcacctggtccccatcaccaaatgaatctgaatcttaagtccaggactgaattttaaaaataagaccagttcagttctagctgaattcccagcctagtctgatcactaaccaggtttagggtctcagtttcgatacagtgaaattataagacatttgagaaataattcattgtagttaaaatcttcagtatctacactcccctgaactctgaatctgcaaaagtagtccattcctttctgttaagggatagcattttttcattgtttgaagatgatatagtgtcctcttccttgcaggacagtttatgtcccacctatgatttgtgcttggtatgatttcaattattttaagtcattcaggcttgcttcatgagaaagtttgttgttgatcttacaatatgttccatgtaaaaatgagtggaatgtatattacgtggttgtagggtggagtgttctgtagagctttaggtccaattggtcaagcatcaagtttaagtccagagtttctttgttaggtttttgcctcaataatctatctaatgctgtcaatgtggtgtcaactcctgccactattactgtatgattgggtaagtcttttcataggccaagaagtacttgttttataaatctgtctgcaccaatgttggatgagaacatattttggacaataaaaactgcttgttggattgtatcttttattattaggtaaagccattcattgtccttttaaatttttattcacttaaagtctgttttacataagaatagtaactccttctctttttcattttctgtttgcaggatagtttttactgtaccctttcatttcgaacctatggtataattacaggtaagatgggtctattgaatacaacatactcttgtgtctggcatatcagacactctatgtcttttaagtggtacgtttagcctgtgtacattcagtgagagtctctgtatatgctgcaaggatagtattaatatttgtgattttgatcctttcatggtgtgtttagctggttattatacagacatgactacgtagtttctttatagtgcctgtggactatgtgtttaagtgtgcttttgtggtagaaggggtaattcttttgaatctataagtagcatgcccttaaagacttcttacactgctggtctactagaaatatattctgtcggcatttgcttgccagagaagaatttttttttctctttccattagtaagtttagttcaggaggatacaaaattgttggttggaattccttttctttaaggacactgaaaacaggccccaagtctcttctggattataaacttccttgagaggtctgctgctagcttgatgggattaactctgtaggtgacctgctccttcttgaagactggttcttcaaatcaaccagtcatacaaaaataaagaaaaaaaaattaagaaaaataaagaaaacctctgagaaaatacaattatctaaaaagaccaaatctctgactcattgtctttcctgagagagaagtagagagaattagcaacttggagaatatatttgaggatatagtcaggtctactggggctcacttggggagaagtctggtaggacaacaggccacaccttcactgaaacaaccctgtggaggaacctacacaagcccgtgcatttgtgtgccccagctctccaagactgcagagagtgtagtctccttccttgttcaagtgatgagcatagccaccagcagtgcacttctaagctgcaggctacagccctggggcactgggaccctgtttgtagctcactgctgtggtcacttggggttggattttgggtgcagtgtaaaacctgaagggcttccaaagtgccagaatgcattcagatggagcaaagcactcaaactggcaaacagaggctgtactgtgtacaagcttctatggggcagccagagaggggccatggggttgagggttctggtgggccggtattcctgcagaacatatgtgtcacagttccatttgaaagtaggttctcctctctccccattggttagctaaggccagaacctattagaaatagatgtgcatggtatgtgggcacttatggttgggctccaccagaggtgacctatgcacaaaggtccctggctttttgtctgcagcttcatctctgtgtaatctctgggagacccctctgccagtccacatgtccctgaaggtatggagccccatctagccaggattccagatgtctacagtgagagggagctatctactagtcctttcactcaggtcttccctagaaactgttcagggcagagaatcagctgtattaaggcaccccattcagtgttctcagccttcttctgcttcagcctcagtgactattccttttctccatccacattcagcattttctctccaaagatctgttcaaattatgatgatatgataaaaaacctggtgttcccctggtggcagttgcacatcctgactgcatctagttgaccatcttgaacacatccctgtgtatatattcttttgagaattctctcttgatgtcccttgcccatttttttaatggagttgcttgtgtatggtttgtcaatttgtttaagttccttacagatttttgatattagacctttatcagatgagtagcttgcaattatattctcccattctgtaagtcatctgtttattctgttgatacttacttttgttgcacagaagctctttagttcaattatgttctattctcttgattttattctaggattttatacttttaggatactgtactagcctgttgtcatgctgttaataaagacatacctgagactggataatttataaaggaaagaggtttaatagattcacagttacacatggctggggtggcctcacaatcatgatgaaaggcaaatgagaagtaaagtcatgtattacatggaagcaggcaagggagcctgtgtagggaaactctcctttataaaactgtaagatctcaagagacttattcaccgtcatgagaatagcatgggaaagatgtgctaccatgattcaattaccactcaccaagttcttcccacaacatttgggaattatgggagctacaattcaagatgaaatttgggtgaggacacagccaagtcatatcattcttcccttggccccttccaaatatcaggtcctcacatttcaaaacaaatcatgcactcccatcagttccccaaagtcttagttgatttgagcattaactcaaaagtccacagtccaaagtctcatctgacataaggcaagtattttctgcctatgagtttaaaaatcaaaagcaagttagttactttctagatacaatgaggatacaggcattgggtaaataacactcctaaatggcagaaactggccgaaacataggggctacaggtcccatgcaagtccgaaatccaggtaaggcagtaaaatccaaggggcagtcacctccaaaatgatattctctgactccatgtctcacatacaggtcacactgatgtaagaggtaggctcccatggccttgggcagctcaacccctgtggctttgcagggtacagccctcctcttgggtgctttcatgggctggcattgagtgtctgtggcttttccagttgggtggtccaaactgtttgtggatatatcattctagggtctggaggatggtggccatcttctcccagctccactaggcagtgctctggtggggactctgtttgtgtgtgtgttggggtggggggctgcagggggttgctcacaccacacattttcctttcatactgccctagcagagtttctctgtgatggtctcatccctactgcaaacttctacctgaacatccaggcatttccatacatcttctgaaatctagacagaggttcccaagcctcaattattgatttctgtgtacccacaggctcaatcccacatcaaagctaataatctgccaaggcttgggggttgccccactgaaaccatggcttgaggtctaccttggccccttttagccacagctgggacacaggggaccgagtactgagactgcacaaagcagcaaggtgctgggcctggcctacaaaactattttttccttctaggcctcctagcctgtaatgggaaaggctgcagccaggaacacctctgacatgccatagagacatcttctccattgtcttggttattgacaattggtttctaattacttatgaaagtttctgcaacttgaatttctcctcagaaaatggggttttccttttatatcatatcaccaagctatgaattttccaaacttttatgctctgcctcccttttcaacataagttccaattccaaaccttatctttgtgaatatgtaaaacggaatgcttttgtctgtacccaagtcacctcttgaatactttgctgcttagaaatttcttccaccagatgccctaaatcatctctctcatgttaaaagtttcacaaatctctagggcaggaggaaagtgccaccaatctttgctaaaacataacacagtcacctttgccccagttaccaacaagttcgttatttccatctgagaccacctccgcctggactttattgtccatatcactatcagcattttggtgaaagcactcaacaagtctctagaaagtttcaaactttcacacatatttctgttttttcttctgagtcctctaaactgttccaacctctgcctgttacctagttccaaagttgcttccacattttctgatatctttacagcagtaccccactacctagtatcaatttactgtattagtctattcttatgctgttaataaagacatacccaaggctagttaatttataaaggaaagaggtttaatgggctcagagtttcacataaccaaggagacctcacaattatggcggaaggtgaatgaggagcaaagccacatcttacatggcagcaggtaagagaggttctataaactcccctttatagaacaattagatctcatgagacttatttactatcaccagaacaacatgtaaaagacccaccactatgattaaattacctcccactggatccctcccacaacacatgtaaattataggtgctacaattcaagatgagatttgggtggggacacagccaaagcatatcagttaaacatttacatctttaacccatcttcagttggtttttgcgtatggtaaaaagaagatatctagattcagtcttctgcatatggccagccagttatttcagcaccttttgttgaatagtgagttgtttctccattgcttgttcttattgactttgtttaaatcagatgactgtaggtgtactgctttatgtctgagttctttaactggttccattggtctatgtgtctatttttgtaccagaaccatgctgtttcagttactgtagccttgtattatagtttgaagttgggtattgtaagcctctggttttgttgtttgttcttagaactgttttaacttttgggctactttggtttcacaggaattttagaaaattttttttctaatttcattgaaaatgttcatggtagtttgatagaaatagcactgaatcagtaaagtattttgggcagtatggtctttttaacaatattaatttttctataattgagcatgaaacatatttctttttgttggtattgcttctaattttgtcaacagcattttgtaatgtttgggtagagatttctcacttccctggttagctgtatttctaggtatcttatctgtggctgttgtaaatggtagtgcattcttgatttggctgtcagattggaggttgttggtataaaaaaatgttactgatatttgtacacacattttgtctcccaaaactttgctgaagttgtttttcagaagtgggagcttttggacaggggctttagggttttcactgtataaaatgataactctgtgaagagagatagtttgtctttctctctttctatttggatgccttttatttttctcttttactctggctaggacttccaatactatactgaatagcagtagttagagtggccatcactgcctttttccagttctcaagaggaatcctttgagcttttgctcattcagtatgatgttgactgtgggttttcacagatggctcacactatttttgagtatttttatttaactcataatttgttcagggatttttaaaatgaaattgagatcaaacaatcattaaaaaacatcaacaaaactgaaagtttgttatctgaaagagtaaataagatggataaatcactagatagactaaaaaagaataaaaaagggatgatccaaataaacacaatcagaaatgacaaagagaagatcatcattgaccccaggaaaaacaaactacctgcaaagatcattatgaatatctctatgcacacaaacttaaaaacctagaagaagcagatatatttctggacacttacatcatctcaaagttgtaccaggtagaaatagaaatcctgaagtgacccaaaatgtgttccaaaattgaatcagtaatataaagtccagcaaacataaaaggcctgaatcagagagattcacagccaaattcttttatacatataaaaagaaatactagccatcctactgaagctatttcaaaaaattggagaggagggcctcctacttaactaattctatgaggccaagattgctctgataccaaaacctggcagagacacaggaagataagaaaatatcatgccaatatccatcatgaacatggacacaaaaatcctcaacaaagtactaactaatagaattcagcagcacatcaaaacctaaccaccacaatcaagtaggcattaatcctaggatgcaagattggttaaacatatgcaaataaataaatgtgattctccacatacataagactaaaaagaaatacaccacaatcatttcaatagatgcagcaaaggctttcaaaaaattcaacatcactttccttttttattttgaagcactctcaaaggaaacaatttaatacttctgctcaaacttcaggagatagtggtaacagactactactaagatatctccataatcttgggaaagactgtggctactacaaaatgaagcttgtgtgctggaactcccttgacagtgaatgaaagagggaatcagaaggcttatgacagtggatacattaacatagacatcctataccatgttggaaatctatagaatgtttgctgaagttataatgaatgttcaatatgtctaccctctgagggctaggtccttttggacttaccaaaccaatctcactgatatgatttatgatcagatattgaaataatagagaccttcagaaggcagatggtcaaaataaacaagagcactaagactggggtgttatccagaaagacctaatttatgaaagctgtgtatatagtaacagagaagatagcactaggggcaaaatagataggtgagcaagggaatttctcaatctataataccagaagagttcaagaatggatactaaaaagttgagggcagctgtcctcactagaaatcacagtaaattgtcaagggtctggacctaagtgtgttttcagacctgaaatttattgactgaagaagacaccagtggctccaggggaaaaaaaacagtaaactgtaaaaccaaggaaacttacatgctactgattccataatttttttttttttcctgaaatggagagtggcatccctaggataactgatgatttcctcagcctccaaaat

SEQ ID NO: 94 - DNA, 568133 bp, Homo sapiens
  misc_feature (200303)..(300302): n is a, c, g, or t
ttactgcaaaatgatttaagttggcagaagccaaatgcactgccatatttttttagaaaagaggtgatgttgtagccggatgcacattaaggactagcagcattacttgtctccaaaccacagaggaatatggtggtcccagattttcagttttgttccccaactccatgtatctgagtcccattattttgctcttcaggccctaaatgtggcataaagtgtagtagaggcggacagtgtcgtctcctgtgcatcactgttgttttgcgatgaaattctcaatgtggtcagctgctgctgctgcagaagtcgattttcttcaaacactgccaagaacatctgacttacatagcatattttgatttgatatttattcaaactgagccttttttctttttacaagctctctgaaactgttaaaagtcttcactttataaactatgtagttaccatgatctttatactgttggtaaagcaatgattcactttccccgtgtctttcacctcagttcttttcttccctgtgtgaattgtatccattttgatcaaagtgattttactgaataccaggagttatcacctctcaagtgttgttggcaaggagactgtttttgccagttatcagtgagttattaaattccaaagtcccattttgagggtctgctttttagtgccacttgcccaagctgccatagtctatttttctcagaaagcaaagcctgagataagaattagtgtgcaataactaatttgagaaatgttcttagggtacaggagtaggggacaggaaagggtgaaacaagaagggagaaaagtcagtacaagaatgtgttaccaaactaatcatcaccgtgactgttgggacttaagctcatgtggacccagtaggaagctgtgtggatgtaaggcgtgatcattaaccatcactttctattgttcacactgccaggttatgcacatgtgagtgagtgttagctgagtttctttgacggttccatgaagagatgttaaagaagactggtgcagaaaatgagagacctgtcctatcagaagatgactttacaaagctccttgacacagcaaaggctagagaaaaaaaaattagctgaaaaatatggggtgcaacctaatttgatcaaatgtattagagctttcttttttcttttgtttcattttcacagtatattacatttcatatgattgaatactgtaaattttctcagttttctgataaagttatgtctgtgatacaggaactagaaagaaattattcaggcagatagtgagggtgagagtcctcggtaaggttttgttttaataaaaagcagctccgcaaatcatttccttgctaacaaaaagcagcctgaaaaatcaagcttcaaacatagagaaacaagctaaaagcttgcataggtagggaaaagaaagagagatcagactgttactgtgtctatgtagaaagggaagacataagagactccattttgaaaaagacctgtactttaaacaattgctttgctgagatgttgttaatttgtagctttgccccagccactttgccccagccactttgacccaacctggagctcacaaaaacatgtgttgtatgaaatcaaggtttaagggatctaggactgtgcaggacatgcctttttaacaaaatgtttacaggcagtatacttggtaaaagtcatcaccattctctagtctcaataaaccaggggcacaatgcactgcggaaagccgcagggacctctgcccttgaaagctgggtactgtccaaggtttctctccatgtgatagtctgaaatatggcctcatgggatgagaaagacctggctgtcccccagcctgacacccgtaaagggtctgtgctgaggtggagtagtagaagaggaaagcctcttgcagtcgagatagaggaaggccactatctcccgcctgcccctgggaactgaatgtctcagtataaaatccgattgtacatttcttcaattctgagatgagagaaaaaaaccaccctatggtgggaggtgagacatgtttgcagcaatgctgccttgttattttttactccactgagatgtttgggtggagagaaacataaatctggcttacgtgcacgtccagtcatagtaccttcccttgaacttaattatgacatagattctattgctcacatgtttgttgctgaccttctccttattatcaccctgctctcctactacattccttcctgctgaaataatgaagataataatcaataaaaactgagggaactcagagaccggtgctggtgcagatccttggtatgctgagtgctggtccactgggcctactgttgtttctctatattttgtctctgtgtctcatttctctttctcagtctctcatcccacctgactagaaatacccacaggtgtggagggtcaggccaccccttcacttgctaacaaaaagcagcctgaaaaatcaagcttcaaacatagataaacaagctaaaagcttgcataagtaaatgctggcaactgtgccaataattcctcaaggatctagaactagaaataccatttgacacagcaatcccattactggatatatacccaaaggattctaaatcattctactataaagacacatgcacacatatgtttattgcagcactattcacaatagcaaagacttggagccaacccaaatgtccatcaatgatagactggataaagaaaacgtggcacatatacaccatggaatactatgcatccataaaaaagatgagttcatgtcctttgcagggacatggatgaagctggaaaccatcattttcagcaaactaacacaagaacagaaaaccaaacaccaattgttctcactcataagtgggagttgaacaatgagatcacatagacacagggaggggaacatcacacactggggcccgttgaggtgtgggggactaggggagggatagcatcaggagaaatatctaatggaggtgatgggttgatggttgcagcaaaccactgtggcacatgtatgcctatgtaacaaaactgcatattctgcacatgtaccccagaacttaaagtataattaaaaaaaaaaaaaagaaagaaaagggatgggataccttgaagccaggtatattcaacagggaggttccctctttcctttcctttgtcaaccacacgtgcaataaagaagcaggcaacatggcactggccaggtagagaaagcatatgcataatagaagattagggtggggcagcaagcttcttcttacactatgtaaatggcacccctggttccaccaatcctttgggccctatataaatcagacactgcttcctcaagcttgtctataaaacccagtgcatttcgccatggaactagaagatctatttgggatcacctttctgcaggaaagagagctattctcttttctctttctttcccctattaaacctccattcttaaactcacttctcgtgtgtccgtgttttcagtttccctggagtgagatgatgagtcttgggtatttaccccagacaatgatgctgcttaacctgttacttttatttattcttacttgaaaaatttttatttattttttatttattttacttaaattctgtgatacatgtacagaacgtgcaggtttgttacctaggtacacatgtgccattgtggtttgctgcacccatcgacccatcatctaggttttaagccctgcgtgcattaggtatttgttctaatgctctctgtctccttgtcccagaccccctgacaggctccagtgtgtgatgttcccctctgtgtctatgtgttctcattgttcaactcccatttataagtgagaacatgcagcatttggttttctgttcctttgttagtttgctgagaatgatggtttctatccacatccctgcaaaggacatgaactcatgcttttttatggctgcatagtattccatggtgtatatgtacacattttctttattcggtctatcattgataggcatttgggttgtttccaagtctttgctattgtaaatagtggtgcaataaacatacgtgtgcatgtctctttatagtagaatgatttgtaatcctttgggtatatacccagtaatgggattgctgggtgaaatcgtatttctgcttctagatccttgagcaattgccacaatgtcttccacaatggttgaactaatttgcactgccatcaacagtgtaaaagtgttcctatttctccaaatcctctccagcatctgttgtttcttgactttttaatgattgtcattctaattggcatgagaaggtatcttattgtggatttaatttgtatttctctaatgaccagtgatgatgagctttttttcatatgtttgttggccatgtaaatgtcttcttttgagaagtgtctgtttatagcctttgtgatggtgttgtttgtttttgtcttgtaaatttgtttaagttccttgtagactctagatattagaccgttgtcagagggatagattgcaaaaatgtttgccgattctgtaggttgcctgttccctctgatgatagtttattttgctgtgcagaagctctttagtttaattagatctcatttgtcaattttggcttttgctgcaattgcttttggtgttttagtcatgaagtctttgcccatgcctatgtcttgaatggtattgcctaggttttcttctagtgttcttatggttttgggttttacatttaagtctttaatccatcttgagttaatttttatataaggtgtaagaaaggggaccagtttttgttttctgcatatggatagcaagttttcccagtaccatttattaaatagggaatccttttcccattgcttgtttttgtcaggtttgtcaaagatcagatggttgtagatgtatggtgtatggtgttatttctgaagcctctgttctgttccattggtctatatatctgtcttggtaccagtaccatgctgttttggttactgtagctttgtagtatagtttgaagtcaggtagagtgatgcctccagtttttttttttttttttttgcttagggttgttttggctatacaagctcttttttgttccatataaaatgcaaagtagttttttctagttctgagaagaaagtcaatggtagcttgatttgaatagcattgaatctataaattactctaagcactgtggccattttcatgatattgattcttcctagccgtgagtatggaatgctttttcatttgtttgtgtcctctcttatttccttgagcagtggtttgtagttctccttgaagaaatccttcatgactgtttttaggagtattcctaggtattttattctctttgtagtgcttgtgaatgggagttcactcatgatttgactgtcagtttgtctattatcagtgtataagaatgcttgtgatttttgcccattgattttgtattcagagactttgctgaagttgcttatcagcttaaggagtttttgggctgagatgatggggttttccaaatatagaatcatgtcatctgcaaacagagacaacttgacgtcctctttttctatttcaatacactttatttctttctcttgcctgattgccctgggcagaacttccaatactatgttgaaaaggagtagtgagagagggcatccttgtcttgtgccagttttcaaagggagtgcttccagctttttcccattcagtatgatatgggctatggatttgtcataagttgcttttattattttgacatatgttccatcaatacctagtgaattgaaagtttttagcatgaaggcatgttgaattttatcaaaggccttttctgcatctattgagataatcatgtggtatttgtaattcgttctgtttatgtgatggattatgttcattgagttctgtatgttgaaccagccttgcatcctggggatgaagctggcctgattgtggtggataagctttttgatgtgtggttagattcagtttgccagtattttattgaatatttttgcatcgatgtccatcagggatattggcctgaaattttcttttttgttgtgtctctgccagtctttggtatcagcatgatgctggcctcataaagtgagttagggagaattccctctctttctgttgtttggaatagtttcacaaggaatggtaccagctcctctttgtacctctggtagaatttggctgcaaatctgtctggtcctgggcttgttttagttggtaggctattaattactgcctcaatttcagaacttgttattgttctattcagggatttgacttcttcctggtttagactggtgaggctgtatgtatccaggaatttatccacttctaggttttctagtttatttgtgttgagatgtttttatagtattttctgatggtagtttgtatttctgtgagatcagtggtgatatcctatttaacttttttcattgagtctatttgattattctctcttttcctttttattagcttggctagtggtctattttgttaaccttttctaaaaaccagctcctgcattcattgactttttttgaagggtgttttatgtctccatctctttcagttcagctctgatcttagttatttcttgtcttctgctagcttttgaatgtgtttgctcttgcttctccagttcttttaattgggatattagggtgtcaattttggatctttcctgctttctcttgtgggcatttagtgctataaatttccctctaaacactgctttagctgtgtctcagagatcctagtatgttgtctctttgttctcattggtttcaacaaactttgttatttctgccttaattttgttatttaacccagtagtcattcaggagcaggttattcagtttccatgtagttgaatggttttgagtgaatttcttaatcctgagttctaattgtattgcactgtggtctgagagactgtttgttatgatttccgttcttttgcgtttgctgaggagtgttttactcccagttatgtggttgattttagagtaagtgctatgtgctgtgagaagaatgtatatctgttgatttgggttggagagttctgtagatgtctattaggtctacttggtctagagatgagttcaaatcctgaataggcttgttaaatttctgtctcattgatctgtctaatactgatagtggaaagttaaagtctcccactattattatgtgggacctaagtctctttataggtctctaagaacttcttttatgaatctgggtgctcctgtattgggtgcatatatattagaatagttagctcttcttgtttcattggtccgtttaccattatgtagtggccttctttgtctcttttgatctttgttgttttaaagtctgttttatcagagactaggattgcaacccctgctgctttttgctttccatttgcttggcaaattttcctccatccctttatttgttttgagcctacgtgtgtctttgcatgtgacatgggtctccttaatataggacactgatggatcctgactctttatccaattttcccatctgtgtcttttaattggggcatttagcccatttacatttaaggttaatattgttatgtgtgaatttgatcctgtcatcatgatgctagctgtttatttttcacattagtttatgcagtttcttcatagagtcattagtctttatattttggtgtgtttttgcagtggctggtactgatttttcctttccatatttaagtcttccttcaggagctctggtaaggcaggcctggtggtgacaaaatcctcagcatttgcttgtctgtaaagattttatttctccttcacttatgaagcttagtttggctggatatgaaattccaggttaaaaattcttttctttaagaatgttgaatattggcccccactctcttctggtttgtagggtttctgccgagagatccactgttagtctgatgggcttccctttgtagataacctgtccgttctctctggctgccctacacattttttccttagtttcaaccttggagaatctgatgattatgtgtcttggggttcctcttctcgaggagtatgttagcgttgttttctatatttcctggatttgaatgttggcctgtcttgctaggttggggaagttctcctggataatatcctgaagagtgttttccaacttggttccattttccccatcacttttgggtaaaccaatcactgcttatttcattaagttgaccttcagtctctgatatcctttcttctgcttcatcaattcagctattgatacttctgtatgcttcacgaagttcttgtgctgtgtttttttttttttttttatatctccatcaggtcattaatgttcttctctaaactggttattctagttagcagctcctgtaaccttttatcaaggttcttagcttccatgcattgggttagaatatgagttcccctctagctgagaggagtttgttattatccatcttctgaagcctacttctgttaactcagcaaactccttctccatccagttttgtgcccttgctggagaggagttgcaatcatttggaggagaagaggcattctggtttttggatttttttttttttttttttgcatttttacgctagttttccttatcttcctagatgtatctacttttgatctttgaggctgatgaccattggatggggttttagtgtgggggtcttttatgttgatgttgatgttattactttctgtttgctagtttttcttccaacagtcagctccctcttctgcaggtctcctgcagtttggtggaggtccactccagaccctgtttgcctgggtatcaccagcagaggctgtggaacagcaaagattgctgcctgctccttcctatggaagccttgccccagaggggcactggcctgatgccagctggagctctcctgtatgaggtatctgtcaacccttgctgggagttctctcccagtcaagaggcatggggttcagggacccacttgaggaggcagtctgtcccttagcagagctcgaggactctgctgggagaatcctccttgtcaggatccactcttctgttcaaagctggcaggcaagaaggtttaaatccactgaagctttgcccacagttgctccttcccccaggtgctctgtcccagggagatgggagttttatctataagtccctgactggtgctgctgcctttctttcagagatgccctgccgagtggggaggaatttagaggcgtagtctggccacagctgctttgctgcgctgtggtgaattctgtccagtacaaatttcctggcctgcttagcactgtcaggggaaaactgcttactgaaacctcagtaatggcccctccccccagtaagctcggttgtcccaggttgacttcagattgctgtgctggcagcgaaaatttcaatctagtggttcctagcttgctgggcttcatgggagtgggacccactaagcgagaccacttggctccctggcttcagtcccctttgtaggggagtgaatggttctgtctcacttgggctccaggcacaaaacaaacaaacaaaacaacaacaacagcaacaaaaaactcctgtagctagcttggtgtctgcccaaacagctccccagtttggcgcttgcaacccagtgctctggcgatgtcagcacagaagggagtatcctgctccgtggattgcaaaaaccatggggaaagcataatatctgggctggatagcatagtccctcatggcttcccttggctgtgggaggaagatccctggcaatgcagaaacaccctgccttctgcattggtctcactgagagctgcagacaggagctgttcctattcaaccatcttgccagatctccatcttctcaaagttttactgtttctagtcttatgttgccatctttcatccattttgagttgatttttgtatatgataaaaaataagggttcacttttttcttttggttgtggacatccaattttctcagcaccattttttgaagaaactcatctttcttcattgagtatatttgggactcttattgaagatcagttagctgtatatattcatggatttatttctaggctttctagtttgttatgtagatctgtatctgttaatgtggtataatatacgtgttaatttttgtatgtgaaactatctttcattctaggaataaacttgccatgtcttctaggaaagaagtgatgctgagtctgaatacacagtaaaagccaagcaacactactggtcttgcaatctcaaaaggaagagtgagactttttacataatttaattattgaagatttcattggcaaaattaaaaacaaaaattctgctcaaaatgaagccaaaatattctgagtatttgcaaaacaatgttgatactatgagtggagttgttaatgttttgtgttcaaatacaatgtgtgaaacataaggaagctcagtaacttttgtgtggggtaacttttggattagaataataaatttcaatataagcccataaggttttatattattatttttcatagcttaaaaatcattgacatagaataattccaactaaagtacatattaaattcctggaaaataaattttgacttaacagggtaagttgtgaaaagacgttttgtcgcaggaaaaaggaaatcctccatttaaaaccctccatgctggaataaaggaggagtcccatcttttggtcattccacttcaggcttttgatataactaatcccttttcttcttctttcctgttttggcaagctttcggaaacaaaacaggcaacattttgtgatcataaatatcatagttgccacgcaggccagcaggaatgctatcacatccaaagagtggtactggatccaggtgaggttgtgggctgcgacccgaaggtgcttggctcctttatggcgcatgacaaactcaatccagaagactgctcgatccaggggcttcaccggttgatcatgatgaattcttgataatttcatgatattctctttatagctgaaggataaatataaagatatcaacattaaaagtaaatttattgcttaagcatatcaagtctatggatggtctttgaaaagcgccacacaagtgattcaaagtaagtgtcattgaattgacataaaatattaatgttttaatgtatgtcattacagaaagtttggtttttaaattggagttttatcactgacaaatacctttaaaaatgaaaaatggaattttcggtgggaaagttaatgtttttctagagcagaaaatattgtgagccattctaagtgctataagtaagatagtggaaatagaatctgggaatgatcattttgatatttttagttttttttttttttgagacaggcttttgctccattacacaggctgagtgcagtcacatgatcatggctcagtgcagcctttccgtttcggtctcaggtaatcctccacctcagcctcatgagaagctggggctacagctgcgcaccaccatgcctggctatattttttattttttacatttttagatatgaggtcttgctgtagtgcccatactcatctggaactcctgtggtctaatcattctgcctctgtctcccaaagtgttggccctacagacatgaaccactgtgcccagcccattttgacatatttaaagaagaattgtgtcacaactggtgaaatgtctcctaactagtttctcagcttctactctaatcttctgtcttctaccgtattttcctactagtagccagaacattttctaaattaatgtcaaattatgacagttgcctgtcaagatttccatctggtttcttgttacattaagaataaaatccaaatctgtctgtggtctagagaacgctacacagacacctacttgtcctaaccctttccccctgtacactttcttctagagacaatggccttctgttgttctttaaactcctgaaggtgttctcaccttagcccgtttacaccttttgttccccgtgtctctctcattgagcattctttcttgcaactacttgaggtttgcttctatttctttttgaggcttccccttaaatgatacctcttagagagtgttttcctggccacactataggcacccataggatttctctactgcttcgttcttattttgctatttgatttctggaactttaaaatatgttatatatcttccacaataaaagtttaagtatgaaatacataggataaatgtatatacgctatgtgactatctcaaaattttaagattatcttaaacattatccaaaagtgaaaacaccaatttatcacaaactgcatagaagaactctttcctcctgggccattttagtcactacttttatcctcaaagtaagtattaacctgaattctaatatcatagattatgtttatataattgaattaaataatacttattcatttctgtttttgtttagcagttgtttaattgcactggtgtagagtattcagttgattgacaaagaccacagatctcttcatttatgattaatggatatttgtgttgttaacattttttgatcttactaataattatggtattaagatatttatatattttattagatttacatacttattcatttttgttggatgtatacttggaagaatagttgatgagagaaaggcatatttataattagaattttttgactgaattttttaaaaaatattttttattttaaagaatcagagattgtttttagttatcattttctggatgatttataatttgattctagtatgactagaacatactatttttatgaatttgaatcttatacaatttacttagcatttttttatggcccagcatatggtcaattccagtaactatttcatacatataatctttttttttttttttttttgagacagagtctctctctgtcacccaggcttgagtatgacggagcgatcttggctgactgcaacttacgtctcctgggttcaagtgattctcatgcctcaacctcccaagtgtctgggactacaggtgctcatcccccacatctggctaagttttgtattactagtggacacaggatttcaccatgttggccaggctggtctcgaactcctgaccaaatgtgatcctcccaccttggcctcccaaagtgttggaattacaggtgtgagccaccacacccagtctccataaactcttttaaaaatgtttattttctgtctacacacacacaaccagagatatatgtatggatacatatatacagatatatgtgcaatatatatacacacacacacatataacacataggttacatttaattgtgtacttcaaatgttttatctccttaaataaaagttttcaaagatcattattttgtctactttggtctgtttaaatttaatgcgagtactggtaggttcacttttttgttgtgatctttgagatggagtctcgctctgtcaccaggctggagtgcagtggcactatctcagctcactgaaacctccgtctcccaggttcaagtgattctcctgcctcaaactcctgaggagctgggactacaggtgcacaccaccatgcctagctaatttttgtatttttagtagagacagggtttcactatgttggccaggagtatggtctcgatctcttgacctcgtgatctgccctcctcagccacccaaagtgctgggattacaggcttgagccaccacatctggtcggttcacattttttaaaaacagttttattttaagttccaggatacatacgcagaatgtgtgggtttgttacataggtatatgtgtgccatggtggtttgcagcacctatcaatctgtcatctagattttaagtccctcatgtattagctatttgtcctgatactctcactcccattccatgccccgaatggccccggtgtgttttgctcccctccctgagtccatgtattctcatttttcgactccctcttatgagtgagaacatgtggtgtttggttttctgttcctgtgttagtttgctgaggataatggctttgagtttcatccatgtccctgcaacagacataatctcattcctttttatggcacatagtatgccgccatactgtacatgcatcatattttctttatccagtctatcattgatgagtatttgtgttggttccatatctttgatattgtagatagtgctgcaatagacatacatgtgcatgtgtctttacagtagaatgatttatatgcctttgggtatatatcaagtaatgagattgctaggtcaaatggtgtttctggttctagatctttgaggaatcaccacattgttttccatgatggttgaactaacttacattcccaccaaaaatgtaaaagttttcctatatctccccagtttcaccagcatctgttgttttttgactttttaatcatctccattctgactggcatgagattgtatctcattgtggttttgatttgcatttctctaatgatcagtgatattgagcttttctcataagtgtgttggctgcataaatgtatttttttgagaagtgtctgtttatatcctttgcccactttttggtggtggtgttttttttcttgtaaatttgtttaagttacttgtagattctggatattggacctttgtcagagggatagattgcaaaaatgttccctcattctgtaggttgcctgtgccctctgatgatggtttattttgctgtgcagaagctctttagtttaatttgatcccatttgtcaactttggcttttattgtaattgcttttggtgtttgtgtcatgaaatttttgcccacgcctatgtcctgaatgatgttgcttaggttttcttccagggtttttatggttttgggttttacatttaagtctttaatccatcttgagttaatttttgtataaggtgtaaggcaggggtatagtttctgttttttgcatatggccagccagtttccccagcaccatttattaaatagggaatcctttcccattgcttgtttttgtcagttttgtcgaagatcagatggctgtagatgtgtggtgttatttctgaggcctctgttctgttccattggtctatatgtctgcttttgttccagtactatgctggtttggttactgtaaggtgtaaggaagggatccagttgcagttttctccatatggctaaccagtttttccaaaacaccatttattaaatagggaatccttcccctaattgcttgtttttgtcaggtttgtcaaagatcagatggttgtagatgtgtaatgttatttctgaggcgtatgttctgttccattggtcaatacatctttttggtaccagtaccattctgttttggttatgtagcctaatagtatagtttgacatcaggtagcgtgatgcctccagctttgttctttttgcttagggttgtcttggctatatgggctcttttttggttccatattaaatttaaagtagtttttttctagctctgtgaggaatgtcaatggtagtttgatgggaatagctttgaatatataaattactgtgggaagaagccaagatggccgaataagaacagctccagtctacagctcccagtgtgaatgacacagatgaggaatgatttctgcatttccaactgaggtactgggttcatctcccaggggactgtcagacagtgggtgcaggacagtgggtgcagcgcaccacgtgtgagccaaagcatggcgaggcattgcctcatcagggaagcacaaggggtctgtgaattcccttccctagccaaggataggggtaacagatggcacctggaaaattgggttactcccaccctaatactgcgcttttccaaaaggttttagcaaacggcacaccaggagattatatcgcgcacctggctcagagggtcctacgcccacggagcctcgctcattgctagcacagcagtctgagatcgaactgcaaggcagcagtgagactgggggaggggcgcctgccattcccatggattgaataggtaaacaaagcggcccagaagcttgaactgggtggagcccaccgcagctcaaggacgcctgcctgcctctgtagatccacctctgggggcagggcataaccaaacaaaaggcagcagaaacctctgcagtcttaaatgtccctgtctgacagctttgaaaagagtagtggttctcccagcacgcagcttgagatctgagaatggacagactgctactcaagtgggtcctgatccccgagtagcctgactgggaggcaccccccagtaggggcagactgacacctcacacagccgggtactcctctgagaaaacttccagaggaacaatcagacagcaacatttgctgttcactaatatccactgttctgcagtgtccgctgctgatacccaggcaaacaggatctgcagtggacctccagcaaactcgaacagacctgcagctgagggtcctgactgttagaaggaaaactaacaaacggaaaggacatccacaccaaaacccatttctacatcgccatcatcaaaaaccaaaggtagataaaaccacaaagatgggggaaaaaagagcagaaaaactggaaattataaaatcagaatgcctctcctcctccaaagaaatgcagctcctcaccagcaatggaacaaagctggatggagaatgactttgacgagttcagagaagaaggcttcagacgatcaaactactccggactaaaggaggaagttcgaaccgaaggcaaagaaggtaaaaaccttgaaaaaagattagatgaatggctaactagataaccaatgcagagaagtccttaaaggacctgatggagctgaaaaccatggcacgagaactatgtgatgaatgcacaagcctcagtagctgatttgatcaactggaagaaacggtatcagtgatggaagatgaaatgaatgaaatgaagcaagaagagaagtttagacaaaaaagaataaaaagaaatgaacaaagcctccaagaaatatgggactatgtgaaaagaccaaatctacatctgattggtgtacctgaaagtgacggggagaatggaaacaagttggaaaacactctgcaggttatcatccaggagagcttccccaatctagcaaggcaggctgacattcaaattcaagacatacagagaatgccataaagatactcctcaagaagagcaactccaagacacataattgttagattcaccaaagttgaaatgaaggaaaaaatgttaagtgcagcaagagagaaaggtcaggttacccacaaagggaagcccatcagactaacagctgatctcttggcagaaactctacaagccagaagagagtgggggccaatattcaacattcttaaagaaaagaatcttcaacccagaatttcatatccagccaaactaagcttcataagtgaaggagaaataaaataaaatctctaagcatttacagacaagcaaatgctgagagattttgtcaccaccaggcctgccctaaaagagctcctgaaggaagcactaaacatggaaaggaacaactggtaccagccactgcaaaaacatgccaaatgataaagaccactgaggctaggaaaaaacggcatcaactatcgagcaaaacaatcagctaacatcataatgacaggatcaaatttacacataacaatattaaccttaaatgtaaatgggttaaatgctagaattaaaagacacagactggcaaactggatcaagagtcaagacccatcactgtgctgtattcaggaaacccatctcatgtgcagagacacacataggctcaaaataaagggatggaggaagatctaccaagcaaatggaaagcaaaaaaaggcagggattacaatcctagtctctgataaaacagactttaaaccagcaaagatcaaaagagacaaggccattacataatggtaaagggatcaattcaacaagaagagctaactatcctaaatatacatgcacccagattcataaagcaagtccttagatacctacaaagagacttagactcccacacaataataatgggacactttaacaaaccaccgtcaacattagacagatcaacgagaaaaagttaacaaggatatccaagaattgaactcagctctgcacgaagaggacctaatagacatctacagaactctgcaccccaaatcaacagaatgtacattcttttcagcaccacaccacaccaactccaaaactgaccacatagttggaagtaaagcactcctcagcaaatgtaaaagaacagaaattataacaaactatctctcagaccacagtgcaatcaaactagaactcaggattaagaaactcactcaaaactgttcaactacatggaaactgaacaacctgcttctgaatgactactgggtacataatgaaatgaaggcagaattaaagatgttctttgaaaccaacgagaacaaagacacaacataccagaatctctgggacgcattcaaagcagtgtgtagatggaaatttatagcactaaatgcccacaagagaaagcaggaaacatctaaaattgacaccctaacgtcacaattaaaagaactagagaagcaagagcaaacacattcaaaagctagcagaaggcaagaaataactaaaatcagagcagaactgaaggaaatagagacacaaaaaactcttcaaaaaatcaatgaatccaagagctggttttttgaaaaggccaacaaaattgatagactgctagcaagactaataaagaagaaaagagagacgaatcaaatagatggaataaaaatgattaagggggtatcaccaccgattccagagaaatacaaactaccatcagagaatactataaacacctctacgcaaataaactagaaaatcaagaagaaatggataaattcctcgacacacacaccctcccaagactaaaccaggaagaagttgaatctctgaatagactaataacaggctctgaaattgaggcaataattaatagcttaccaaccaaaaaaagtccaggaccagatggattcacagctgaattctaccagaggtacaaggaggagctggtacccttccttctgaaactattccaatcaacagaaaaagagggaatcctccctaactcattttatgaggccaacatcatcctgataccaaagcctggcagggacacaagaaaaaaaagagaattgtagaccaatatccctgatgaacatcgatgcaaaaatcctcaataaaatactggcaaactgaatccagcagcacatcaaaaagcttatccaccttgaccaagtgggcttcatccctgggatgcaaggctagttcaacgtacacaaatcaatgaatgtaatccagcacataaacagaaccaatgacaaaaaccacatgattatctcaatagatgcagaaaagacctttgacaaaattcaacaacacttcatgctaaaaactctcaataaattaggtattgatggggagtatctccaaataataagagttatctatgacaaacccacagcaaatatcatgttgaatgggcaaaaggtggaagcattccctttgaagactggtacaagacagggatgccctctctcaccactcctattcaacacagtgttggatgttctggccaggagaataaggcaggataaggaaatacagggtattcaattaggaaaagaggaagtcaaattgtccctgtttgcagaagacatgattgtatatctagaaaacctgatcgtctgagccccaaatctccttaagctgataagcaacttcagcaaagtctcaggataaaaaatcaatgtgcaaaaatcacaagcattcttatacacccataacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggaaacaaaccaatggaagaacgttccatgctcatgggtaggaagaatcaatatcgtgaaaacggccatactgcccaaggtaatttatagatccaatgccatccccatcaagctaccaatgactttcttcacagaattggaaaaaactacttgaattcatatggaaccaaaaaagagcccgcatcaccaagtcaatcctaagccaaaagaacaaagctggaggcatcacactacctgacttcaaactatactacaaggctacagtaaccaaaacagcatggtactggtaccaaaacagagatatagaccaatggaacagaacagagccctcagaaataatgccacacatctacaactatctgatctttgacaaaccttacaaaaacaagaaatggggaaaggattccctatttaataaatggtgctaggaaaactggctagccatatgtagaaagctgaaactggataccttccttacaccttatacaaaaattaattgaagatggattaaagacttacatgttagacctaaaaccataaaaactctagaagaaaacctaggcaataccattcaggacataggcatgggcaaggacttcatgactaaaacaccaaaagcaatggcaacaaaagccaaaattgacaaatgggatctcattaaactaaagagcttctgcacagcaaaggaaactaccatcagattgaacaggcaacctacagaatgggagaacatttttgcaatctactcatctgacaaagggctaatatccagaatctacaatgaactcaaacaaatttacaagaaaaaaacaaacaacctcatcagcttgtgggtgaaggaaatgaacagacacttctcaaaagaagacatttaggcagccaaaagacatatgaaaaaatgctcatcatcgctggccatcagagaaatgcaaatcaaaaccacaatgagataccatctcaccccagttagaatggcaatcattaaaaagtcaggaaaccacaggtgctggagaggatatggagaaataggaacacttttacactgttggtgggactgtaaactagttcaaccattgtggaagtcagtgtggcgattcctcagggatctagaactagaaatatcatttatctagcattcccattactgggtatatacccaaagggttataaatcatgcttctataaagacatgtgcacaagtatgtttatggaggcactattcacaatagcaaagacttggaaccaacccaaatgtccaacaatgatagactggattaagaaaatgtggcacacatacactatagaatactatgcagccataaaaaatgatgagttcatgtcctttgcagggacatggatgaagctggaaaccatcattcccagcaaactatcgcaaggacaaaaaaccaaacaccgcatgttctcactcataggtgggaattgaacaatgagaacacgaggacacaggaaggggaatatcacacaccggggcctgcttgggggtagcgggagtggggagggatagcattaggagatacacttaatgttaaatgacgagttaatgggtgcagcacaccaacatggcacatgtatacatatgtagcaaagctgcaccttgtgcacagataccctaaaacttaaagtataataaaaaaaattactttgggcagcatggccatttttacaattctgatttttttatccatgaggatggaatgtttttccatttgtttgtgtcctctcttaattccttcagcagggttttctatttctccttgaagaggtccttcacgtaccttgttaggcatattcctaggtattttattctctttgttgcaattgcaaatgggaatttattcgtgatttggctctgcttgtgtattgttggtgtataggaatacttgtaatttttgcatattgatttttctatccggaggctttgctgaagttgcttatcagcttaaggaattttagaactgagatgaaggggttttctaaatatagaattatgtcatctgcaaatagagacaatttaacttcttctctttctatttatagaataccctttatttctttttcttgcctgattgccctagttcacatttaaatccaccattttattctatatatttttgttttctaacctgttttctgtttctttgcttttttactttatttgaagtattttaaatcatttcttgtcttactaattttttggtaaagtgtttttaatgtattctcttagctggtaccaccttacatcataataatattggtaggattaatagactctgaattgatggtagctggtgtagtcacagcattttccatattatttcccttggattatggaaaactattacatatttattttatcaatattaaaaccttcatgtttcaaaaggcatcctccaaaaagtaaaaaaaaaaaaaaatctatctgcccatagtggaagaaaatatatgaaaatcgtatatttgataagggatagtatctataacatattaataattcttatgaatccataataaggtaaatagaaaaatgacaaaatgttcacaagattaaaatagaaattttatctaaggaagatgcatgaatgatcagtaagcacatgaaaagagggttaacatcttcagccataaggaaatgcaaatgaaaaccataatgagagaccactttacacacactagaaaggctgtaatagaaagacaggtgataacaagtgttgggaagagtgtgaagaaattagagccctcctatccagctggtggtaatgaaaaatgatgcaaatactttgaaaaacagtttagccattcttcataaacaacaatttcccatatgcctcagcaagtccactcctagcctctcctcaaaagaagtaaaaacatatttttacacagaaaatatgtataacaatattcgtaagtgccaaaattggaaagacctaaaatgtccatgccctgataaatgggtaattttggtataaacatatcaaagaatattatatagaaataaaaatgaatgagttctgatacatccaacaacataaataaaactaaaaataattatgctaagtgaaagaagtcgtttacaaaacactataaattgtatgatttcatttatataaaatatgtgaagagaataatctattgagaaacaaagtaagtcggtatttttctaggactggaggtgtattgggagtgacttcatgcattttgagtttaatttgagctcacaaaaatgttatttagggttgtggcttcgtaactatgtaaacatactaaatatatttagattttaaattttagtgaatgttatgctatgcaaattgtaactcattttcaaattgattaaaataatgataataataaaaataaatttttgagaaagaatagattcatactttcagaaattttaggtattgaattgaaatattttatcatatttctctagttacataatttctattgtgtattctatcattaaaaatatttaaaataattatgtacatatctttaatttttttgattttataattcattgcagtcattggtgacccattaaatctgtggggttgaaatgtaactttgaaataattgtctggtggaaaataagagcagattttacattggttaaatcacttcaatcccttcaaaattagtctcttaacaaagggttcaaactcatattcactgttgacaaaataatttgtaagtaccacctggtcacaaaattgtaatactcacatagggtcattaatgactgacttcaatgcattgagcaaatctctacttgacatggtcctgatgtccacactgagggctgctcccttggctttcatgtgagcaatgttatcatgttgatccgcaaacaagggaatgcccaccatagggatcccatggtagattgcctcatagatgccattggttccaccatgagttataaaagctttggttttgggatgacctaaaagtggatgcattttaacaaagttattaattataaggcacaggaattgaataagaaatgcacaatataaggaacttaaagcaaaactgttccctaggtaacattatacccacaaaactgcattgaaattgttttcaaatttcagaggaagaagcacctacttctgctggaaaggtaagtgaaggctacatgaaaaggtggtggtctgtgtgtcttcacagtggaaacataaatttaaaagtttgccaggtgaacaaaatgaaaaaacatattcttaattaaaaaattaaaatgtgcaaaaaagaaaagaataagatttggtatacaagaacatagtctcttaagtagtataaattatgcagtcacatttatatatttaaaaaatatttaaatagttaaaatatttaaaatacttaaatttttttttaaaggcagcaaggagtagggtggaggtggtgctgaggaaggacaggttacacatcatcatgaaatgtgttatcactttatgataaagattggtgatttattcccacagaaaatagagtcactggtaatagaagaatgtctgttatttttcagtacctgttgaaataaccctgcagtaggggaaggaacagatgtaaagttgcagaaataagagacagaaaatccaggatgttatttaaaacctgtgagaggtaattacacctgaataaagagatttttattctgaccataaagaatgtgactgtatgtaacaaaatgccaactaccatagtgtattcttcttatactaagactagaaaataaatataaagtagttaaatttgatttttttttagttttccaataataaatgttaaatatgtttgttttatgttgaaatattatcacttctaattggctgttactaatatattcagtatttgttctccagagtcttaccaagaaggtcattctggggtaaccacttatacagtcgagtattggaacctaaagtatttggcttcttgccatcaaatctccatagaacctgttagggcaaggaaaatatcttgttcaatgaatagaactctaaaaatataacttgttagaattctgaagagattaataatcagttaatccatataaaagatgaagaaataagaagaagtgatgtcaagtaatgagaactactaaaagtctgaggtaagctgaatacccacatttaatatctttacttttataatcaatttggtatataaaaaaatgacatttctaacttaatagctagacacatgagagtgtgagaggaaaataaatcttggtgccccaaaatctatgctaaagggaaaagttaagctgctcagggcaaacctacttcccattctattcaaagtcagcccttggctcactgagataaatgcatatctaattgcctcatttggagaggctaatcagaaactcaaaggaattcagccatttgtctcctatctacctatgacctggaagccccttccatgcttcaagttgctctgcctttgtttctagttgtcccccatttctggactgaacaaatgtccatcttatataagttgattgatgtctcatgtatccctaaaatgtataaaaccaaactgtccccccaccaccttgggacacatgtcaccaggaccccctgaggctgtgtcatgggtgcacattttcaaccttggcaaaataaactttctaaattaactgagacctgcctcagatattcagggttcacattttggtaaccatgaagagactctgagtggaggttccctgacctttgataaatgtcctgtcagtgcttggtaccagcatgagctaactttatggctcaaacaaataagacaattggctgaggtctgggagcaacccctccagagaatccctgataccccaaaattcagtcaagaccaaaagtttattttgctgtacaactcctttttttttgttttttatttttttttggagttttacttgcttcctacaagaaaggcaatatttcctgtttccatgacaatggaaggcaggtaactctatggagtttgagctcactcccaggagggaggataaatttgaggtttctttcctacttctaggacgacagagggcagttttagcctgaaacccatccgtaggtaaatagctgaattggggttttgtcttggttaatgtttaacaactagctggacttaatttctccttaccattacagtgcttaatgatcacatttttgggagtattttttttgtacattccagtatttctcccatcagatttgacaaactttacctgacttgatcatatctgagtgagaattccaaattgtgggtaacaaagcctgtctaatttggtgaaaattcttcacagatgcaaaagagaaaacaaaacaaaacctaaaaaccatgctcttggtttctgtgtttgcttcctgtctttaaaaaaacaaatgttcttttgtttacttttcctccaccctatacctccttttgtcttttgccatttgtagtaccaaaaatctagagaaggcttctaatgatttgaactcttttaaagaattcagaacaaaggcaccactcacccctttgggggtgctctgttttctttgtggagtttcaagagttgtgggcagattttttcttaggtccaaagctctgttttcctatgttgaatgacctgatctctttggcttcgagattaccacagattaccttgtactgtgagaggattttaccttggcgtgtgtaatggcagacgagttacaaagtagagggtggctgagtacagtttactggaagtagtattgactgttgttatttttttcctcctaggaagttgttgtttaagaatcctaattctagtttggagatgtgttgtaaagggtctcctctattgtttttattccccaaattaatctcatttggcttgtctgtgtggatttgtgtgagaaactgaactgtggtttacataggaaaatgaaagactgagttttctcagctccaaagtgaaagggcatctgctcctcccaggcaaaaggcacccctaagcaactgggggccttgtgggagtgtcttgggtttgaccccctatgacatgcagtggtcctgcagggaaatccccaagaaaaattaacttttaaaaaaaggctagtccaggaaacacatatgagggcagatcacccagcattttgagccctctcagaggtcatacacctctggagggagaaactgagacacgtaagagggtggaaacaactcagtggtgacacactgtggagtactgcccacaagcagcacacattgattcaccacacataaaccctaggccacagctcagttcctccttttaggaaaaaaagtgggaaacaaataatctaagaatgatgagaaaagaagaagaatgatcccctgatatcgcctgtttggatttatgacacctctacttggcagagtttatgtaaaatgaaggtaatacggtctttgtgcacatatacattaagagccctaaggttgtcctacaaactgtagagttcctaagttctctcttttttaaaaattttcttttattcttgctttaaatttgcttttatttttctattaagttaaaaaccactgttttgattcaacaggtttttgtctgcaagctggtgatttttttttatctcatagctaaatttctgaagtaaaaaccacataatcttttgtgtgtgtgtaagtgtttgcatatatttaaaaggccattataatttctataattttatgtttaattggcaattaaatccattttattttccttctagcacaccaatttttttctctgtgtacattatgatgtaaattttgctatttgattttcacctgaatggtttcttttaatatgcaaatgtaagattatttagctcacaactgcctatggtgatcaagtattcatacagattacctattgaaacaggttatcaagaatttgaaagtctaatatggcaaagaggagtttttataaacctgtaagatgtacttctgttggcatgcttactacatctatgtatttatgtgttttgtacacaatgttttattactgaaaatatataaaagagctctaattaattggcttaagaaaataaaagtgcttgaattaaatactttgccagaaaaaaagactaattaaatgctttttcaagtttatgtaacttaaataaaatcttttataaataagataacaacaattattgataaagtatgataatattagaaatgcattaagacttgccagcatacatttttgtttgcatttattaatcaagaaatttcatacttattcttgccaaatactttaaggtgtcaaaatttgacataggggttacaaaactgtaaaccaagcccaaaacagaatgatcttcacttgtgtaatttttaataaataagacattaatattggtttaatgcaaatagctacaccttgaattaagtaagattatcataacttctcatcttgtggccttaagcaatctagtccacaggcattaagctttgttttgggaaaagactgttatcatttttatttcaaagctaaactataaactaagttcctccttaagttagtttggcctacacccagaaataaacacggagagcttggaggttaaaagcaagatggagttaggtcagatctttttcactgtctcagttataattttgcaatggcaattccataactttaaatgatgactaccacacttttcacaaatattctaggtaaatgactaaataattaggtaaatgtaatgggataaatacttatagacaaactcataatttagaatctaaggttatattaaattaaataatagatatttcattgtttgggtatttttaaaaaaaaatttgtaggaaaacattctttccaaaaaaaagtgcatcttttttaaaaaggtgaagaagtgttgtctaattcaaagcttatttaaaggttatgtataaaacaaggtaaaaggaaccaggaagtaagggagatgtaaagaaagttataaaaataaaaagttttttttttttttttttgtaaaaagcttgaagagaaataattttatatgagaaagaatcttgtgtggtaaatttagtcctagaataaaatgatcagttgtgtaagaaagaaggatgttcaggacaaaccagaaagtccaaacatatcatgaatgatctgtgtaagtcacaataagaagattaaaaaaacttttatatgatcaagttgtctataattaaagggaaattataatggtgtttctacagattgggcttgatgtaaaaaaagcacttatgcactaaataattggttagaacaataacattttcttaagggattgatttactcttaaaatattatgagttttttttttttaacccaaagtttaacttttcttgcatctcactgtttttggttttctctccccttttaaagggtgtgaaatagtaacactctccttcaactcattttcaactcatgtaagttttttcctcaagttctgtttgttgtggcataatgctaacagtgttttctaaaagctattcaactcctcaaggtccagggactatcacagaagaggtgggtgtgtgagattgaaagaactgatactaagagataaaataagttccgtttatgcataaattaatcattaatgtcaaagacacactaatgcaagaccaacatatgggcccctgtgtcagattaacaaggttttcttgaagcataaactgacttcttaataaagattataaacgttatgaaaggctgaggaaagttatatcttatggtcaagattagaattttatagattgttcatacaattttgaaaaacaaacttatttggcttcatgctgttttattagggcttattgtttggcaaattgagtctcctctctcaaagaatgaagatttttgcctttttttgaaatccttgagttactactttagtcaaatgaatgctttattttacctgtgatatcaagctttttaatcctttgatatttgacaaattttccaaaattatgtttttttctgacctaagtaatcctttaatttattagtttccctaaagtccaaaaatgacataatttggcttatttggtataaaaattatacagggaacattgtcaaacatgaaatggtgtttggtctttttgagctgtatttatataaatatgttattggcatgtgttccaaaattatgggaaactcctataattctgatatgacttagtgtgtacattatcagtaataattatatttgttatgttaagttattgtgtgccacagaggtaacaaatttccttgtccattgtgtctttgactgaggctgccctaaaactttttgtcatccacagacaattgttgtctgactttggtcctctttagaaggcgattttatactcagccatgaaattctaacaggtgctcttgaaaaaaagtttttgataattttggagattgtgacattagaatggaagaaaaactttcaggactcatggagaactaaaatgttcatgaatatcaagcagaacaggaattaactacatggactgaaataatagaaaactaaagtaatctttttgactttgcttaaaacattgctgatcctttgttttgttttgtttttttttttagagtgaaggaatctttctttttttgagctattaacagcttttaacaatttagtatactcctatgaaaaaaatttagaacatatttgtttccctctacctgatttttcagaatttggaaactatttgtgagtattttttacttttgtcaatacagttatttgcataagtgcaataagaatctattttcatttttaacaaaacacaattggagaaactggttattttatcaaggcttccactggaatggtgggctttcctttagggaatcaaacttaacttatggagccaataaaaccccttgggaaaactggcctcataccttcatctataaggtccctgtacagggttcctgaactgtgttaagcaaagaatgtaactttctgacaggcccaggagccccaagtttattttggaaccccaagaggagaggaattcacccaactcataggtatttgatggtacaaatctatggcttgcctcagctttaaaaaagtcctatctgagattctttctataagacaaagttccatcaaagccactttaaaagcctatgtaaataaaaaattattcttcctcctctgtatacaataatcaggccaagtataataaagcaaatcagttgtaccatggtttgtctttagtaaaattgggaaactgaagacagaaaaattatgtttcaaaaataacagtatacctgttgttagattctagtcttgcctaatgtttttcaatttttattactgtctacagtttggactgaattctaatttttcatggctacacgtcttcaaaatagtgtcttcaggttttttttcctccccttccacaatttttcctaatttggagtcactgtaaactaagctatgctttcataaagccctacaaattaagctagacaacttaaactccagaagaaaataacagcaaccaatttacatacataatccactttcatacctgcctactgatttatggacttcagagtaatgtggcctatattaattttaaaggattgttcttttgtttttgtttttctcacttcctccctttattttgtcttcacagtacatgagacttcagaacctgctaaaaatgaactttcctaataactcaggacctgcttaggaataaaccttccttgccattagagatcagatgaaaacctgagaccagagactcattttcttctaaaatgctttctccaaaagatttttttaaaatgtaaaatgaaaataaacctgggggccccaaagtcactaagcaaatcactgcctcccattctattcaaagacacccctctgctcactgagataaatgcatatctgattgcctcctttggagagcctaatcagaagctcaaaggaatgcctcttccctgcttcaagttggcaaaataaactttctaaatgtactgagacctgtatcagatatttggggttcacaagattatcaatgaaatattcaaatatataagaattgttaggcagtcttaattctagtaataaaaaagtagcaaattagtaataacctatatatttattttatatactttatactagctgtaaccttccaaatttaatataaatttattaatttttgagtgatatgggaagagtttacttatatccacttgtctactagtcataagttattttatgaatttgacatcattgattacaaaagactaaatacttaaactgcacatatggtgagaaataatgctacatatgtagtaaattcagactattatcagtattgctacttttgtaaatgctaacaatgtaggaaaaaggagcccattgacaattcatgattaacaatacagatgctgagaatgtagaaaattgtattttgctactttttgcttaactgatctttcacacttagatgatgcactacctagcattgacagccttgatatatggtcagctatagccagtcattaccatgtctagtaccaaactaaggtactgattttagatttcccaagcaatctttataaactggagtagaatttacaagtgttgtccttgtatttgatatgggagtgttaaagtaactctgtgttttcagcaaaaacttgcatagatcattcagagagggctatgcagataagaaagtaaaacgtaaattgaaaatacacaaagattgtaggtatattctatagattagaaaataagttcctaccatgtttatttatagttcctgctccttcctcaatgtggagaaggcactaatctgattcttagagcatagtctttgttgggccacatttaataatgcacatagtctaccctaaaagcaggattctatctccatcctttccattacatttttctgcttaagacattagcggcacccaagccagcagagcagacaagtttttctttttctctaaatctacttggctaggtgggtacctccagagcagtggctagtcagactaggacattctttctctgaatggcaccctgaacagaacgctaaatagacctattccaatgcatgggaagtaaaaacagccagattgcttggtaagacgaagctgcatgatgcatttcaaagttttttcaatacctgcttattgttattgtgatagtacagtaacttattaaaattttaccgctttttgataatatctacagtgtatacagtaccttctaaaatcctgtaaaccaaaaggagcaaatgacagggcagaatttagtgatttctatgtacatgctacgataccatgataataccaaacttcactagcacctcttaaatatatttccttctgatcacaatattaatgccaacgttattatcaaccaaaactcctctctttatgattttaagatcttccatatatgtttttgctttgaacagatgtctgagataattagaactatcatagcagttaaattttcaggcagaacatttctgtaatggactcttgaagagtttaacagattcatttagtagccatccacagttaaggcactttatctaaccttttgtgggatctgggcaagggctgatgcaatcatgttggcactttcttctgacatgttactgatcatcgaccccagagaaaacaccacaataccattttctccagagctctgcacaaactcttccatttcctgtgaagaaagaatttgttctatcagaaaagagcaacagcacagaaaacactgttgacaggattgttacaaacatctaagatgagaaagtcaggagctattggagtaatttttttaaactgacctaatcattcagtttctttgaaaggagatgtgtaatataatatatgtgggatctttcatgcaaatttgtgtaaatatgtgtgcatatgcatgtatgtatgtgtgtgtaaggaagaaatgaaacaaagctatgacactgcagtaggaggagataatgctagaaaatattacacccagacactttatttataatattataattactaacataggttattggaaggtagctttacttggctttaattctatttttttttgtagttctactaaatctcttgtgtttatttggggtcattttattttatttttttctgttcagttcttttagttaggagtcattggagccattacatgactatgagcaatgaggaaaagttagttacaattagaatgattttatatctacatttatttagcttctttagctctctaaccctttatatttcacttagagtttcctagtcttaccccactacccctcacttcccccgacacccccacccccaaaaaacaccttaaaagctgaagtataagaatcattgacgttcatcagtctggtgttggggcttggaatttccgggaaatagttctgagaattccatttataatacagtattatatactatttagttacataattaagtgatcttatttctcagatcattgtttaggtatgactatgataccttttgtcctgaaatcacactgtgaaattgatgtgctatttataacttaccatgagggaccctcatcctcactttgctgtgtctcacagggggcacttgaaccacagtgggagaggtcaccaagcctttctccagtggagatctgctcaccccctagagtagctccctcacactatatgaagctcctggtaaatatgtgtttgcttcgaaatgaatgagaattattctgacttgtgtttcctgatgtgttcctgtttttaaacttaaatccattctctaatgccacatcagtcaatgtattctcacaccaaaaaaaaaaaaaaagaaaaagaaagagagaaagaggaaaagaaatgtagactcataagtttcccggatatcatatcaaaattgtatactcatctttttgttgctattgtcccttttgttctaaattctttttttctcagtaaaataatgaccaaccccttctatcataacaaatatactttctggtcctaatcattgggggaaatttctttataaaactgtttacgaataaaaaaggaaattctaaaatatgtcaattcagaccatatattggtatttttcaaaaatataattgaactttatgacatcttttatttttattttattttatttatttatttatttttgagatggagtcttgctctgtcacctaggctggagtgcaatgatgcaatcttggctcattgcgacctctgcctcccaggttcaagcaattctcctgcctcagcctcctgagtagctgggattacaggcacctgccaccacgcctggctaatttttctgtttttagtagagacaggtttcaccatcttggccagactggtcttgacctcctgacctcatgatccacctgcctcggcctcccaaagtggtgggattacaggcttgagccactgtgcccggtctgatatcagttttaattggagattcagtgtatggctattagagttaattcatgaggcatccaggaactcagtgtaattgcagttgcctgtagccacatttaatgtaacttcggtttaatgttttgtctcattcactgacaaaagtcttcttcatccaccaagtattgaagtaaaaaatcgtctgtttatagacagatcagcactgatctcattctgtgacgtctttatgaaagcaatggtaatagaagatcaatgtaagtagtcttgtaaaagtatgaaaatttaggaaaaaaatcatttttcccatatctctatctcaatttaaaatgtgtaccatttcattatggttttaattctatttatataactcaatgtacatatgtgatgtttatttagaaaattttttctcattgtatatgcctttttatcctacaaaaaaattgtgatcttgttctactcatcattctgttccttagtttccaactatacctgtactacagctgacagtgtaattaaacattgttttgaaaaaatggattgtaatggcttggtatgcgcattgtataagtttttaaccatttcttaatgtaagatatttgaattatttccagagttttttaacgaatatttgctactaatattgaatcttaccatcatgatttattctctgtacagtttcatgtgaatatattacaaaggcaataactatatgcagttttcaaacacttgatactttttggcaagagtcttattcttttgaaatatacaaacattatctgagaatctaatacataatggaaaagcaagcaaatttgtggcaacaattattttgtgtacaaaagaattagagaatcggtttcacaattatttacttagattcaagtctaccttttgcaggttaacaacaacagccagtgccgggcacggaggctcacacttgtaatcccagcactttggaaggttgaggcaagtggatcacctgaggtcaggagttcgagaccagcctggccaacatggcgaaactctgtctctactaaaaatacaaaaattatccggatgtgttggtgggtgcctgtaatcccagctacttgggagtctgaggcaggagaatcagaatcacttgaacctagagggtggaggttgcagtgagctgagatcatggtagtattagtaataatcactattgtactactagtcatttattccttgtcctccttattctcctattctcttccccctgctaatggcactatcactttcttttgatgtgagtgaggatttttttttgagaataagataagagtacacagaattaccttttaagctaaaatattaatgaagtgcctccacctttgcaatacaactttagctttccagcgtgttcaactgactgcccaaacttaaacatttatatttaaacaagcacacagagtatctgttctctaggattttgctaggaaaatcaatcattattaaatgaagactgatatcttaaatggctggcacatgttagctaatttaaaatattagaaataatgactaaaataataatcataatatcaacaatatttttggatcactggctatgtgtcagagacaacttaagtgttttatctgtggtaactacttttttccacacaacacaatatgaagttgtgattattattgtaaaagtagtcatgattgcctaaactcatgtaaaagttcctaaatattctttacattgtacaaagttgcctttctgtaatattacacattgagaacattgggattttttttgaaaggaaatctgatcatatctcttcatttcttaactcttttcagtagctctccattgtccttaatgggtatatcaaatttcatatatatatatatatatatattttttttttttgagacagagtctcactctgttgcccaggctgttgtgcaatagcatgatctcggctctctgcaacctctgcctcccgcgttcaagcgattctcctgcctcagcttcccgagtagctgctattagaggtgcctgccaacatgcctgactaatttttgtatttttagtagagacggggtttcaccatgctggccagtctggtctcaaactcctgacctcaggcgatccgcctgcctcggcctcccaaagtgctgggattacaggtgtaagccaccacgcccggcccatcattgacttttactcaaccttttcctgtaaactaaatttggagtcctgggaactgcccttactgcttttctacttttctgccttaatgcaagactttacttttttgtttgtttatttgtttgtttttgagacagagtctcactccgtcgcacaggctagagttcagtggtgtggtctcagctcactgcagcctctgcccccagactcaagcaagcctcctgcctcagcctcttaagtagctgggactatgagactacaggcacacaccagcatgcctggctattatttttatttttgttagagatgaggttttaccatgttgcccaggctggtctcaaactcctgagcccaagcaatcgtcccttctctgcctcccaaaattcagggattataggtgtgagccaccttgcctggcctctggttttctttttgggtctttctcatcccctcatcgtttcacctatctctgcacattattgagtactcactttaattgtcaatgagtttgggatctcttctgcatatttctttatcattgtggtctttccttataacactttttagacttttctttttcacttgtttttattctatctttcaaagtacaatgttaggcatgagggcgcagaaactgtgctacctttattctctgaaaatccagcacttacctgtggtttgcattaatcactctacaaatattttttgaagaaatgaaccatactatcttgtgggttgcacaatgaaggccttactttaaccaaccctgttttcaaaatctccctagtaaacctctttggtctttaatgataataacattcacatacttgtgatagtatagaaatatatgattttctaatggcaagtccttttttttgacctcccatattcccctcactctgagttaaacactctgaaagaaacatatccagccattccttctgaaaatgtcaagcaaacaaatgaaacaagaatatgttcaccttaggcaagggtttggctggtttacagtgaagtcctccaacaaaatcaacatttggtaagaatgggcgaggaaattcaaaatcccaataggttcgaatgagccacatttcagctttccccattgtctcaaataatgtagtgggtcttcctgatggaaaaaaacaaaacaaaacaaaaggtagctaacacgagaattgttattttaatattgaatatgcaggtattttcctgaaaggacttggaataacatacctaaaaatatataaaatgtctgcacattgataatatatataaatacatttatataatataatacattatattaaatacattatattaaattaatgtatattaaataatattaaatacattatattaaattaatgtatttaatatatgttaatatattttaatttaatagtatttaatttttaatttttaatatttaataaagtttaatatttaatattaataaaattttattaattttattttattaataaaacattaataaagttaataaaattaaacaatatttaatatttaatttaatatttaatatttaatagttttaatttaatatttaaattatttaataaaataatttaatataatgtaaatacattatattaaatacatttatatagtcatcatttaatttttatgtattgcatatgttgctcatatgtatatataaggaaggcaaagtgttcagagagctgtaagaagaaatcacatctttaatgtaacatcagtatattcacaatcataaataattattaaaataagtcactaatatggtttgactgtccccacccaaatctcctctcatcttgaattataatccccataatccccatgtgtcgagggagggacccagtggcaggtgattggatcatggtgtggattcctccatgctgttctcatgatattgagtgagctctcatgagatctgatagttttataagtgtctggtatttcccctgcttgcacttctctctcctgccactaagtgagaagatccaagcttgcttccccttagcctttcaccatgattctaagtttcttgaggcatcccagtcatgtagaactgagtctattaaacttcttttctttataaattgcccagtctcaggtatttctttacagcagtgtgagaatggactaatgtagccactatgaacttaaatacacatttgtcttccctctgaagctgcaatagtaacaaatatacctttaaacaactctttcagttccacaattaattcatcttaccttacccatgaaaacagctttccaggaagtactctagtgtctacagtttattaagctagtcccttgatccttggttctcaaagtaaaccatgagttttttgagctcaacactgaaatctttacacctactactgtcttggttcatcttaagatcttaatataattagatttttaaaataaatatatttacaaatgagaattaaaaatttttcagaatttattgacatagagatatgtgctcttccttattttggcccctattttctttgatggagagatgcagtttaataaaatatagattaaaacttagatgttcactttcaacaagatttcagtttttgaaggaaataattgtgaagttgttattgaaggaatgtataaatattagaaatctcaagttttaggcttctgtttctggagtagagccactatatttctcaactgtgaaggaatccttcttatatgaaaaacaaaatttaatttctaaatgaggaaactgaggtactcaggtacaagttcctcaatcctgcattgataatatttttagaaatatgtgtaaatataaaatttgtatgtctgccttcatgaagatgtttcttgaagtatctattgacttttttaaagatgaaaaaatgtatagcaaaatgatatgtgatggcttaaagaaatcataagtgttttacattgaaggtttatgactctcttggtgtcctatagcagtgatggcaccagggttctaactgattctataaggtcaacattctatatttttgagactcatagatcatcttacatttgcaattcataatttcccataaaaacactatcttctgacattatatttatataagcccaccttcaaaggcacaggaaaattagaacttaataaacaccaattggacacacgacttacctagaacttcactataaaactggtcccacttcttcagatcatatgcttgaaaccaaaagtcaaaataaagcatatatatcatattttttatcctctccatgaaaatcatttgatcacttaattctgacataacaacaggtacataggaaggagggaacagaaatcctccaccattcttctcaactgtgtagccaacagagaagcggagactgtacagaaagggtatgttaagtagctcagccagcagctcaccacagggattaacggcatctgccagaaggacatcaaattttgactcttgtagttttctcataagtttcttgttcaaaactgcatcttcacagagctttatattatagtcagaatattcccaacacaattcttgtagttgtgaaaaatatgaccaaaatgtattttttgaaatactatatgtccatctatcgaacattttcataaaaaaatcttccaaatcatttttagttaaagatgtaggataaacttctaatttaatagcagatgatttactggcattgacaagaatagaagccgaagatgtcaacacaatcacctcatgacccctctgaacaagctcttccaggattgtcttcatatttatccaatggctgtattctgtgggccacaccagcacctttccacaactcccagagctaaagtaacaactgagctgcatcagcagaaagactgacatccatttcagagacatcctggtcttatgcagtgcttcttttccagttgttgtttctttctgtcatttctcatacttatatctgaggaaaaatcaatcaagttaaaatataactgctaaaatttgagttgacctcatatttattttagtgtgtttggtgttcttttatatttacaattactctagtcaagcaataatttttatgacctagaatacgtaagtaacctgtcttatgtaattattttataatactgttaagaacagtggcaggtgagaggctcctgcctgttcggtgcccttgacatagagagaagaagtaattatacaactcaaacgccattttttaatatcgtggtgcaagtaatgtcttctaaaactttgttgacacataattcatataccatatgactcaccaattagtgtgtacagttcaatgtttcctagtatattcacagaattttactttcactacaataatcagtattatctccaaaagattctatacaatagcctctaaccccccactctgaaattttgcatccatcctaccctaggcaaccactaatctaatttctatctctatagattagcattttctggaccctttaaaaaataaatgagggttttccagtgatcatggcagatgggatgcaggactagattgcagctccagacagagcagcatgcagaggcttgcattgtgaattttagctgcaggtcaactgcaaggacagaccagcaattctgagaggatccacacaccctctgcaggaagcgtactgctcctgcaggacctgggagacatcccaaacactgtgagtgccccaacaatggaagtgggaaagggtgatccccctctccagaatacacatccccactggagaagctgaagttctgtttgcaggagaagttcctgactttatgtgaagctgagtcaaattagagaaccaagccaagcaaaatataggggtagaggaagtagcagaaaggtactgggagctctctggatacccaagcagctcattcctgcctggcaccacagtgatcctttaggagggtggccagcggagcagggggttcaaagattcttctggggcctgaaagcttgaagggatgagtaactcctcccttctcaggcccagtcccaagatgcaaggctgcttgcatcagcagcgtgtgtcagcaagatagcagaagcaggaagagagccggccagaagacacctaccctggctggagacatgaacccttgaagatcaagaggccatccagatactacatagcagtcacgttagattgggacacttactctttacagagaactataaaaccactgtcccatcctcacttggggctgatgccattttaggcctcagcccacctgcacccaggcactcattaaaacagcacgctgctccgcactgcctcgtgttgtctgttggcatgctctcagggatcaaaccaattcaagaaccttatatctggtgccaaaacctgggtggggctcaggtctgtgtcccttgtggacctacccctccaccccagagagcaagccacagcaaccagacaaaggaaactcctcagcctccagttgcctctctgtgcatgtgtagcaggatgagccacagacaaaacttctcagacaccaagttgtagaaggaagggctttattcagctgggagcatcggcaagctactgccttaaaatccaagctcctcaagtgcgcaatttttgtcctttttaagggctcacaacactaaagatttcacatgaaatggtcgtgattgatttaagcaagcagtgggtatgtgacaggtgctgcatgcactgctggtcagagagaaacagaacagggcagggggttttacagtgttcttctgtacaatgtctggaatctctgaataacatcggtttctaagttatgagttgatttttaactactgggtttaggtcaggcaggcccaggcctggtttcaggcctggagccaggctgcctgtctttggttttacttctttgttgttttttcttaaaacaggtactgagcataaaacaatataaaataatctgagagggtccttctcttccttcattccccccttttgagactctcactttttattagtgggagttctcactcatttttttacttatgtctttttgtggaatagactgatagtgattcatatagtacagttgtgctgaagcattttgttgaactaaggtagcgatgaagctttttatcatttgaagaagtacaggtagcaaacaagggagcagtaagcaggtttttataattattgtaactcctattataagagttttaaatttttctagtgctgggaaccactttctaaacatggcttcagggttgaatccgtgctacacttgcacaggtacatgtgccagttttgtcatatttttaactatgtctttaataacttgcctgattatctatgtgtagacagtaattagtaaggttaaatttttcacaaactcctccttcagctgctagcaagtagtcaagagctagtctattttgatagattgcatttctcatctgagtctcttgccgggcaagaacggtcaaggcttgaccggttttattagtaaaaatttctaaaacagcttgtaaccatatgattcggttgagcatgtagatgggggtccaatatcctcatgagccatcttgtgcctaagtggcgggtccatagtattgtatgatttttttcagggggctatttatcatcttttcctatggctatgcttcatttttttgttcccaggaagcatagactgggaagcctagaagttcatgtttttatgggcagtaagaagaaagaaggcttaatggtgcgaattacacagctacctgtctactgatcaggcagcttagcataagctttgtgtccacatatatccagtataatccggtgggggccgtccagtcccagtggaattctgggtgggcccaaacagtctgcaactttggaaatttactgaatggatttctttctgtgtaattggaactccaccatgtgactgtttttgtggtactattatagagcttttgtctaagacagctaagctgccttacaggatgagtgaatccttttccttctttagctatgcaatactgtctaataattgagacttttagaacctagagatgatcagggtgattcttttgggctgggaattcatcaggaaatgggtctgtaggaactaattcttgggcttcctatggccattgatctactgttatggttcctccacaaacataatatgaggtgacttgtagagactgggctacgtgttaggctaattgcaaaaagaaatttttagtttttcctggaatctcaggtactggcacatttagttcatcatagaaagtctgaaacactggttctggagagcgtttttgaacctctccttttattaggatgcttacattaggatctagtccctttttatccatgtctaatgatatatatttttcttttattttactttgggtctgaggggtttgtgattatcaattctaaaaggttgtagctcctattcatgcaagaggggctgagttttcctttttggagtcaaacacgatcttttttattttccttttaagtagtctgaatgacacgagaccagtattgacacatctcacataaatatgatttttgacagatatacttattttttttactgtgtaactttcttttttaatttagagaatcacatcctgtttcatgctgcttactattaatagcggcacaagtgtcaaattttaaggttacattttgaggagctctgtttttttcggttctacctattaccttacttgtgtcacatagaaaaggagcagtccttaattttattttaaaaactgtgatcatgggaggcttaaaattgttcataacacacatcaggttggttatttcctgggctacataccttggatagaatagcattatacaaacaatttgttgttgtttttgttgctatttaatttttttagagtcctcgggcgtccgtgatattagtgttagtcagttttgttgtgagtgttagaaagagggcatatagaaccaggaagctgataagaaagacgattatgagggcgtgatcatggaaggcaattagctcttttataataaccataaagtaattagctcttttataataactataaagtaataggactgtagcaatcttttgttccacctcagtgacttgatgtatatactggaaacagttcttagtctgaggaaggtcagttgaagtccttcctgtacaagtccaaattctgaggaaaatgagtcctgcgatgagtctcctcatgcttcagccatgcgtggaccagtcagcttctgggtgtgactggagcagtgtttgttgtcttcttcagagtcattttgcagggattggtgaagctgctcccatccacgtacagctcccagtctactgatgtacagttatgtttaactgggctctctgataataggagtaagatagtgagcttagggtgttgcaaacttcaatggttatgtggggattttcacaatgcaagctttggtatctagttagtctatcatttattagctaatgatgtcctttggtatttattaaaattaccacagcatggggagactttatgtttaggtttttcctaagagttagcttatttgcttcttgtgttaacagggctgttgctgccagggcccttggacatgggggccagcctttggaaaccccgtctagttgttttgagagacaggccattggccttggccaggaacctccagtctgggttaaaactccaactgccatttttttctctttctgacacatagagtgtgaagagttttgtcaggtcaggtagcctcagggctggggccgacatgagttttttttttttttttaactcatgaaaagctctttgctgttggttgtaatagatgtagtttatctaatctacatttttattgactgttatctactaaaatattgacttaaatcttgtaactatttgatttcaagctttaaattgatctggtattccttgcagggcttcgattgcatctaaatagatgtgagagttgaaagacttataaggggctcctctcactttacgatgtgttattattattttttccttcctctggttgatgaaatgccagggtgaaagggatagcccaatggactaaggcacaaatgccactctagttatttggcagagtgcctagtaaaggtccaccacaatactaccacacatctgctcagggatgaacaagggctgattgattgataagctcttgaaaattcttaagctcactgcatccttttaggtctccaaggaatgctaagtttcctccctgccgtgagagacaggaagtgaacttagtgttgagagacagaagctggatggcccttgggggctgactggcagggacttcaggatatagcagagagagcttggcatgacttattactccaggctgtagaatcctggaaaagagctaccatcaggcccacacctggtgaactggaggaccaccgtagtgggaaggggacaattagggcctctggcctgccatgtgcacaagcataacaattgcttttgtttattgtgtagttggaatatttgatccatttcaaccaggcatttgtagcttgatatactgtcttaattgctaaagtttgttttaagtctttaacttttatgatcctctagtaaaatgaatatttccattagcactaatttttattagtttttagaccaaagaaagctaaacatcattttatatttaatgtttcttgtatgatttttataccagataagctaaattttacttttatattagtgtgttattaatattaaacttaattttaataaaaccttgtagacatatttatccaatttttcatagttgaccataaggtaagattttatagactctgtttaaccttttacaatttttgttaaagagcaggttgatgctttaaggaaaaaacctgttgcatttttactttcatgtctagttcacagaaaaactggataatacttttttaactttagctaataagtttacacacagaattttctttaaattaacattttaaaacttgcttgaacttttcaaacaataattcttttttgactttttaatgtaggtaaaaatccacattcttatgcctccttataatcttctcattaaagttatattttacttttttatacacctgcacataaactgtttcttcaatagcactcaggaggccttattacttttaaattatgcaacattttttgcataaaattttttataactttttttcacgactttcgccaacaatttttcaacatgtctcaactttctgacttattacaaacatttttttcttctctttaaacaacaagttaatttatttcaggacaagaatttaccatataacactctttttacataaattttacctcctccccccccttttttttttgaagataaccattccttttttttaaaaagtgaactttctttatgtctttggactagactgtctaaggccacaagattagaagttaccataatatgtgttacactgtcaacttttagcaaacttcgcttttgttgaaaaccttgtaagtttgaaatttcaattatcctttgctattaataagaccttgtttagtctaaatttacttagaattggtatagatggccttttttttttttttctctgctggtctttccttgcctctgccagctgcttatgctgctgttctcttaactattgtgagggggggtggggggaaggggtctaaaaccagctgtaactgtctatgtacagaacctggtctgggtgccttggcttacaggttaccttgtgccataccttagaaactaaaaagacctatctaggcttccttctgatggctaacctacctctaatgctggccaatctatttcacacaaagttctaagttttcctggagtcatagtgactccatagtctctattaaatcctttcttgaaattcattatcatagttcccagtgcagtgggcttactttgtgcctgatctatgtttttttgagacaaaacaccatgctcacagcacacacacaccacaaaacaaagaacgggtaaaagggcacacacaaacatttcagtttacaccaaaccaaaatcaaaaccaaaatcagagtatccagaaatccaagccaggtcaaaaaccaaaaccaaagtatccagcaattcaagtcaagtcaaaaccagatcaaaagtgccaatacaggcacaccgtgggtgatcaggctatgctacacttccattcaggtggagtggggcaagttcaaaagactagtcctaccaagtctagccaagtcaaaaccagaacaaaggtgccaacacaggcacaccgtgggtgaccaggccatgcttctactcaggtggagtgggacaagttcaaaagactagtcttaccaagttccagatgtccagactccaagtgccagttccttcccggtgttcagccactgtgttaatcctccacgggggcctgctacgtgttgatctggtgaggtgttccactggggcaatttcctacccaggagcgctctttggatctcatcactcaggctgcccggagtaccccacagggatgctccacagggcaggcttaagccacctaaggggctgcctcagccttccgtcagtcaccttgcttctgggtcagggagccaagaaatgtagcaggacgagccacagacaaaacctctcagacatcgagttgtagaaggaagggctttattcagctgggaacattggcaagatactgccttaaaatctgagctccccgagtgcacaatttctgtcctttttaagggctcactacactaaagatttcacatgaaagggtcgtgattgatttgagcaagcagtgggtatgtgacaggggctgcatgcactggtggtcagagagaaacagaacagggcagggagtttcacaatgttcttctatacatgtctggaatctatgaataacattggtttctaagttatgagttgagttttaactactaagtttaggccaggcaggcccaggcatagtttcagtcctggcgtttgggctgcctgtctttggttttacttccttgttgttttttcttaaacatgtactgagtgaaaaacaatataaaataatatgagaaggtctttctcttccttcacatgcacattggtcactgatctcgcctactgttaggcttccctgggagcccagttaacaggggaaaatctgcatgacctctcttggtttctcctgtcccaaaatccaacactgatccaagaaggctccagtatgtgccaggcactccctgatcatctggtcttagggggacgcctctaagccatttgattccgttccaggaaccaaaaaggcagaggtgataatagctccttttattgtcttcctccagctgtccaggacagtcttctttttccctgttctccagagcctaccctttgatatggaaaactccccatcctccattccaaaaaacagccctccagactgcctcataaaaaatctgcaaaccttaggcctcaggcaagatacccaccctaagcgccttgtcttttttatacaataaaacctggccgcagtatgaattagataacgggtccaaatggccagcaaatgaaacacttgactttacaattttaactggttaaagcaattattgccgatgactggaaaaatggggagaaattccttgttccaggcctttttgcactcagatcacaacctgacttctgcaattcttgcttacctgttcaaatccttcattctcaccgccctcataacctttctcctcctgaccctacctctttttccttgttggatccagcagactgctgtccacccctcccagcccctacccccacgtctcaaccatcttctataactccccaagctttctcattgtcttcgcagtcaccatcttcccagccaccatcttcccagccggcatcacctccaaaagtacccacttctttttctacaccgtcctctcctcaggaaaactctagcattgcctgtactcagtctccttcctcactgccctctcctgaagcctgtaaacccatcaagccaccttacacccctatgtatcctccactgcctgtcaactcaacccgccttcccccttcaaaccctcagcaggaaccccttctggcttctttcttctctcctgtccataccagcttgggcaccatctttggcccacgctgcacccatacttcagtgcgggtgctagaatgcccccttcaggaagtagcaggaactgaaggtattgttagagttcatgttcccttctccttcactgatctctcaaactaacaagactcagttcatttccagaagaccctacctcttatattagggagtttcagtaccttacccagtcttatgcactaacctggtatgacctctacttatcctgtcttccaccctcaccttctacttatcctctcttccaccctcaccccagaagacagggaccatatttggaccctggttcaggagcatgctaatacaattcatcatcaagctcctgcccagcctactggcacggaggcagtccccaaccaggagccccaccaggattatcaagacagggcctctggacactgccatcaagaccacatgattgtgtatctccttgcaggactcaaaaagggtgcccataaagtggtaaactataaaaacctttcagaaatcacccaaggtcctgacagaaacccagccttttttctctcttgtttaactgaagccatgagaaaatataccaacctagacccagccaacccagaaggaatcactattttaaacctttggttcctcatccaatctacccctgatatttggtgcaagattcagaagcttgacaatggccctgaaaccccacaatgacaccttcttaatttagtcttcaaagtctttaacagttataacgaggaaagtaaaagaaaaaaaaaaaagacagagtttcaaatgcttgcctccaccatcacgggccctgcaggcccacaggctgcagctccacacagatgcctcctagcaatccacctccccctggcacctgtttcaagtgtggcaatgaaggccactggtccaggcaatgcccaaacccaggtaagcccaccaggctgtgccctctctgcggaggaccccactggaagtcagactgtgaggtgccccagcaaggaccgcccccatccctgccccagccggccaaaacctcctactaggatctcatcagccttgccgctgaagactgacagtgccctggaacagatgccccagcaactaccattgcttcatctgagccaaggataaccttgatgttggcagataggccagtattttttttttaattaatattggggcaacctactctgctttacctaaattttcaggacccacccagtcctcccaagtctctgttgtgggaatcaatggacaagtctccaaaccccaagacccccctccacttttctgctccctgcacaccttttccttcagtcactctttcttagtcctgccttcatgcccagctctgctcctaggcagagatattctttcaaaactccacactactctccacttccacattccccatagtacccaacacatcaacccagacccctccaaggcttctaacaggcttctaactttcttctactcctccgacctcccaccctgaagcatgcaacttttccttatcccgcacctgtagttaaccccactgtttgggatacttccacaccctcggtcacagagcaccacacccccatccacatcacccttaaagagcccaccccgttcctatcacagaagcagtatctcatcccccaagcagctctcataggcctaaagcctatcatttctctcctcctcaccagtcacctactctgcccaacaaactctccttttaacacatcagttctacctgttaaaaagccagatggaacttatcacttagtccaggacctcaggctcattaaccaagctgtactcccagtgtgtccagtagtttctaacccatatactttactttcctcacttccctcgaataccacccatttttctgttctaaacctaaatgatgctttttcacaattcctttacaccctgattcccaaaatctctttgcctttacctgggagaaccccgacacccacctttcaggtcagctcacctcgtgtgtactacctcaaggttttagagacagcccccacctttttggacaggcccttgctagtaacttctgtactttatccctaaaatcatcctctcttctttaatatgttaataatctgctcctgtgtagcccctctcaaagagactgcaacacccatacatactatctctcttttaaacctcttggcagaacaggggtatcaggtctcccctaagaaagcccaaatatgcaccccccagtcacctatctaggcctagctctcactcctgaacgcaagggctcacaacagaccacatattccctccttcagtccctcccgcctccacaaactaagcaagaaattctctcttttccaggattagcgggatattttaggctctgggtttcctccttcgctttacttgccaaaaaattatacgaagctgttaaagtccctctctatgagcctttaaaacctgcacagcctattacccaacctttccatctactccaaaagtctctcatctcagcccccatcctcactctcccagacttcaccaaacctttctccctttatactgatgaatggcgtggagttgcactaggtgttctaacccagtctaaggggcccacccggccaggttgttgcctacctccctaaagagcttgagaccacagttcttggatggcctgcctgcccctgagcattggtggcagctgctctcctcactcttaaaagcctaatactatctcttcatgccaacctaacagtttattcaacccataacatcaaagacatgttagctcaccgcagtgtactaagtcttttctctgccccacggctcctccagctgtatgctctattcatagaaactccccacatcaccatgctaaccacctcccatctaaacctgtccatgctcttacctgaagctacaactgcccaagactctacactcttctgtgtgaatactgttcaaacctttcttataccttttccatacctaacagaccaatcccttccagatgcctcctttatttggtttgtacatggcagctccttcctacatcaaggacactgacatgggggctatgctatagtgtcaccccccaacactattgaagccaatccgctcctcttaggcaccacctcccaaaaagctgaattcaatgccctcactccagctctcactctagcatccggaaaacagatcaatttattcaaattctcattatgcgctccacgtagtgcactcacactcatccatctggaaagaacggggtttcctaactgcaaacaatactcctgtcataagacaagtcttctagtccttgtctgtactttctctgggtaggtagaagaattcccaacaacttcagaaggtgcaactgtcatcgcacaaactcatcatgcatacctgcaattccccgttttggactcccaacatccatccagtctgataacagtcctgccttcatcagccaaattacccgaggcatctctacatccttaagaataaagtaagctctccacacaccctacaggcctcaatcttcaggcgaagttagaaaaattaactctgtctttaaagcccaactcaccaagctggctgtagaaacccaacagtcgtggacaaaaaaaatctccctttcgccctcataagactttgcacaacaccaaaagcacactctttttatagtccctttgaaatcatgtatgaccaaaattttgtcttggggcctccacccttaccagactctgagccactcagaaattaccacccctccttaatccagacatggtctttcatttgtgaagcagcaaatgagccatgcctctccctgtcgacacctcctggtcctctcaacataactgacttgcaggcacagacatgtttccagacaatacagatggtgctcctgctacagcgacatggtggataccaacctgtctctcaagaataccccaaaaattaagttttttttttccaaggtgcccactccaatccctgtgtcatgcctgaagtagttactgagaaagtcaccccttttccctttattctataaccaaataaacaggaagattctccctggggcctgaaagcttgaagggatgagtaactcctcctctcaggcccagttccaagatgcaaagccatttgtgtcaacagcttgcatcagaaagatagcagaagcaggaagagagccaactggaagacacctaccctggctggaagacacatacccctgaagatcaagaaagagaccgtctgggtactacatagcagtcacatcagactgggacacttactgtttacagaggactacaaaacccctgtcccatcctcacttggggctgacgcccctttaggccctagcccacctgcacccaggtgctcattaaaacagcatgttgctccacaccacctcgtggtttctgttggcatgctctcagggtttgaaccgatacaagaacattacaggggtaaaactccacagtaagagggacttctctagctgaactttgtaacaatttgaacaggcaagaagcctcatggccagaaattgggggagggcatgaatctagcttgcagacttcacaggcaggggaagaactaaagcccttttctttgcagctgggaggtggaaaatctcaggcaaatattcaagtccaactctccctcctccttgaaaaagactcgggactattgcaggggccacggtggaagtgggagtggcccttcagtgtgcatgggaggtgggttagaactgagactgctggctttcccacacttccctgacgacctcatgactcagcagaggcagccaaaatccacctaggtacacaactccagtgacctgagaatctcacctccatccccagcagtagccaaagcaaggccctcccaaggaaggtctgagctcaaacacgcctggacctggcccacctggtggtccttccctacccccctggtagcagaagacagaggacctacaatcttgggagttgtagggccgtgaccaccaccagtccctctccacaatactacagctgatgctttctggaaagtaccacctcctggcagaaggccaatcagcagaaaatagagcattaagccaccaaagctaaggacccccacagagtcctttgcaccctccacctgaacaggcactggtatccacagctgagagatccatagatatttcatatcacaggactctgcagacaacccccagtaccagcctggagctggatagacttgctgggtggctagacccagaagagagacaacaatcactgtaatttggctcacaggaagccacatccacaaaaaaaggggagagtaccacaacaagggaacaccccataggacaaaaaaatctgaacaacagtcttcagccctagaccttccctctgacagagcctacacaaatgagaaggaaccagaaaaccaacctgggaatatgataaaacaaagctcgttaataccccccccaaaaatcacactagttcaccagtaacagacctaaaccaagaagtccctgatttacctgaaaaagaattcaggaggttagttatgaagctaatcagggagggaacagagaaaggcaaagcccaatgcaaggaaatccaaaacataatacaagaagtgaggagagaaatattcaatgaaatagatagctgaaagacaaaacaataaaaaattcaggaaactttggacacacttttagaaatgcaaaatgctcaggaaagtctcagcaatataatagaacagatagatgaaagaaattcagagttcaaagacaaggtcttcaattaacttgttccaataaagaaaaagaaaaaagaaaaagaaaatatgaacaaagtctccaagaagtctaagattacgttaaataaccaaatctaacagtaatcggtattcctgaggaagaagacaattcgaaaagtttggaaacatatttgggagaataattgaggaaaacttccccagtcttgctagagacctatacaagaagcacaaagaacacctgggaaattcatcacaaaaagatcttcacctaggcacattttcatcaggttattcaaagttaagatgaaggaaagaagctgggcatattggctcacgcctgtaatcccagacctgatcaggtggtcggaggtgggtggacaacctgaagtcaggagttcgagaccagcctgaccaacatggagaaaccctgtctctactaaaaatacaaaactttgctgggtgcggtggcacatgcctctaatcccagctactcgggaggctgaggcaggagaatcacttgaacccaagaggtagaggttgtggtgagatcatgccattgcactctaacctgggcaacaagagtgaaactccatctcaaaataaaaaaaaaaaaaagatgaaggaaagaatcttaagagttgtgagagagaagcaccaggtaacctacaaaggacaacctatttgattaacagcagatttctcagcagaaaccctataagctagaaaggattagggccctatcttcagcctcttcaaacaaacaattatcagccaagaattttgtatccagtgaaactaagcatcatatatgaagggaagatagccgttttcagacaaacaaatgctgacagaattcgccattaccaagctaccactacaagaactgttaaaggaactctaaatcttgaaacaaattctggaaacacatcaaaacagaatatctttaaaacataaatcacacaggacccaaaagatcattcaaggctgctatgaacacctttatgcacataaactagaaacttagaagagatggataaatttctggaaaaatacaagcctcctaacttgaatcaggaagaattaaatacactgaacataccaataagaagcagcaaggttgaaatggtaatttaaaaattaccaacaacaaaaagtccaggaccagacagattcacagcagaattctaccagacattcaaagaagaattggcaccaatccttttgacattattccacaagacagagaaaagaggaaccctccctaattcattctatgaagccagcatctccctaaaaccaaaaccaaaaaaggacacaaccaaaaaaggaaactacagacctatatccttaatgaacatagatgctaaaatccttaacatgatactagctaaccgaatccaacaacatatcaaaaagataatccaccgtgataacgtgagttttacaccagggatgcagggatggtttaacatacacaagtcaatatatgtgatacatcacataaacagaattaaaaacaaacatcacatgatcatctcaatagatgcagaaaaagtgtttgacaaaatccagcatcattttatgattaaaactctcagcaaaactgacatacaggggaataccttaatataataaaagccatctatgacaaacccacagccaacgtaatactgaatgggaaaaagttgaaagcgttccctctgagaaagggaagaagacaaggatgcccactctcaccactcctcttcaacatagtactagaaatcctagccagagcaatcagaaaagagaaagaaataaaggacatccaaatcagtaaagaagaagtcaaactgtccctgtttgctaacaatatcattgtttaccttgaaaatcctaaggactcctccagaaagcacctagaactggtaaaggaattccacaaagtgtccagatgcaagattaatgtacacaaatgagtagatcttctatacaccaaaggcaaccaagcagagaatcaaatcaagaactcaaccccttttacaatagctgcaaaaaagtaaagtagagtaaaatacttaggaatatacctaacaaaggagtcaaaagacctgtctacaaggaaaactacaaatcactgctgaaagaaatcatagatgacacaaacagatggaaaaacatcccatgctcatggatgggtagaatcaatattgtgaaaatgatcatactgccaaaagcaatctacaaattcaatgcaatctccatcaaaataccacgatcattcttcacagagttagaataaacaattctaaaattcatatggaaccaaaaaagggcccacacagccaaagcaagactaagcaaaaagaacaaatctggagccatcacactacttgatttcaaactgtactctagggccatagtcaccaaaacagagtggtactggtataaaaacaggcacatagatgaatggaacagaatagagaaccccaaaacaacacaaatacttacagccaactgatctttgatgaagtaaacggaaacataaagtggggaaaggacacccttttcaacaaatggtactgggataattggctagccacatgtaggagaatgaaactggatccttatctctcaccttatacaacaatcacctcaaaatggattaaagacttaaacctaagacctgaaactgtaactctagaaggtaacattgggaaaacccttctagacgttggcttaggcaaggatttcatgaccaaaaacccaaaagaaaagcagtaaaaccaaagctaaatagctgggatctaattaaactaacttttgcacagcaaaaggagcaggcagcagagtaaacagacaacccacagagtgggagaaaatcttctcaatctatacatctgacaaagtactaatatccaggatctacaacgaattcaaacaaatcagtaagaaaaaaaaaaccccaataaaaagtgggctaaggacatgaatagacaattctcaaaataagtatacaaatgaccaagaaacatatgaaaaaagtgctcgacatcgctaatgatcaggcacatgcaaatcaaaaccacaatgcaatactaccttactccttcaagaatggccatagtaaaaaaatcaaaatacagtagatgttggcatggatgcagtgatcagggaacacttctacactgctggtgagagtgtaaactagtacagccactatggaaaacagtgtgacgattccttaaagaactaaaagaactaccatttgatctggcaatcccacttctgggtatttacccagaggaaaagaagtcattattcaaaaaagatacttgcacatgcatgtttatagtagcacaattcacaactacaaaattatggaaccaacccaaatgtccatcagtcaatgagtggataaagaaactggtatatccatatgatggaatattactcagccataaaaattaatgaattagtagcatttgcaatgatctgaatgagattggagattattattttaagtgaagtaactcaggagtggaaaaccaaacatcatctgttctcaatgataatgtgggagctaagctatgaggacacaaaggcataagaatgttacaatggattttagggacttgagcagaagagtgtgaggaagcaagggataaacgacaacatatgtggtacagtatgtactgcttgggtgatgggtgcaccaggatttcacaaatcaccactaaagaacttatgtaaccaaataccgcctgcacgccaaaaacctatggaaaaataaaaaaaatttaaaaaatgaaatcatacaatgtatggtctttagtgagtggcttcttgtgcttagcataatgtattaaaggttcacccatggaagagtgtatataaggacttcatttctttctattgtcaaatagtactccaaagtgcatatatactcattttatttgttcatttatcagttggtagacatagattttttccatttttgatgattatgaataatattgattaacatttatgtacaagttttctgtggacatatttttatttctcttgggtgtatatctagaagtggaattactggattacatggtaaatgtatatgtaaccttttgaggaattgctaactgtttttcacagtggcagaattattttccattctcaccaccaatgcatgatggctttaatgtctccataaccttgtcaatggttgttatcctatgttttttgattacagccagtgtgagtgaagtgatatctcattatgatttatatttccttcatatctaacaatattgagcattcttatgtgctaatttcccattatatattttcttagaaaaatttctattttgatactttgcccattttgattatttgtcctccttttatggacttatgcatttaataaatttttgacataagtcccttgtcacatatatgatatccaagtatattatcttatttttttggttgtctttttactttcttaatgatgtccattgaaacacaaaaatattaattttgatgaaatcctatgaatcaacttgaattgggtcacttttatttttagtgtcatatctactaaactatccccaaatgcaaaatcatggacattagcaaccatgtttcattattagagttttacagttctattgcttacatttagcttttaacttattttgagttaatttttgtaagtggtttgaggtagggggccaacctctattatttcgtatatggataatcagttttctcaattacatttgttgaataatctattctttgactcattaaattgggcactttggtcaaaaaccataaatgcgtgagtatattcctagattccaaaatctattacactgatttgtatgcctaccttatgtctgtatcacactctcttgattattgtatattggtatttgtctttaaaagcagaaagtgtaagccttccaactttgttttttattttaaattgtttcagctatttttttttcttctagcttttttttttttttttttttttttttaaggcaggggtctcactacatttcccaggctgaactagaagtcctgggctccagcaatcaatgaatttcagccacctgagtagctggggctacaggtgcatgccactacatctaaattgtttcagttattactgtctcctacatatctacatacattttagaatcagctagtcaatttatgcaagaagttatctgggattttaatagggattgaattgaatctgcataacaatttggggagcagagtatgggcattgtcacaatattaggtgtttcaatacatgagtataagatgccttttcatttatttagatatcatttaatttatttccataatgttttgtagatttcacagggcaagttttactctccttttgttaaatttattgatggccaggcgtggtgactcacacctgtaatcccagcactttgggaggcctaggtgggcagatcacaaggtcaggggttcgagatcagcccgacctacatggtgaaaccccgtctctactaaaaatacaaaaattagccaggtgtggtggtgcatgcctgtaaccccagctactcaggaggccaaggcaggagaattgcttgaacccaggaggtgaaggttgcagtgagccgagatcatgccactgcactccagcctgggctacagagtgagactccatctcaaaaaaaaaaaaaaaaaaaagagaaaaaaattattcacgaactgtatttttgtgctattttaattgtgattgttttaatcgttattttagcctaaatttttattgcaattagggagaaataactttttttttattgatcctatatcctaaaaccttgctttattggtttactgctctaatatttttctagcggatttgtaaatgtttactattataacattatgacaaaagccaataaagatagcttaacttgtttatttctagtatggagtcttttattctttcattttttaaaccaatttatcttatctagaacctctaatacagtgttgaatggaagtgagaaaagccaatttagtctttctccattaagtgcggtgtcagtgtgtgttttatttatagatactatttgtcagtttaaggatgtttctgaaaggtattgcattaatcacatgattttttctgcctttattaaaatgattatgcagttattgtccttattctaatgatattacatattcaccagttttttgagatgttaaagttagtttgcatttctggcataaaattcccttctggttaaagttagtttgcatttctggcataaaattcccttctgtatgtccaaagctttttgcacatgctagggttctgtttgctagtgtgaaagaaaaataaagaatcaagatcctaaagtcactatgccaaagggaaaaaagtttagcttgggaactgagtcacacaaactgtcagaggcattctaaccagagtgattccaccttgaataagtcagacaaggtcaaacctgccaggttacattcccaggggattgagcactcttggttacaagatactcatggttgagggaatgagttaatgatgataattaactaaataaagacccagaacttatgaaaatgtcccaatagtttgaaaacaaaaacttcttaatttaagaattagttttcctttaaaaaactagcccacttgtaaaatcttgctgaaatcaataatacataggaaaataacaatattaatagcctgtcacaagctgatcacaaacctttgtaataaagtacagtattcttaacaacctatataagcaagcactaagtttaaggtaggggtatttctcttcttgctttctgaggatgccctattctgtaatagagtagtctctaacaaactgttaattttactgtactctgcgactcaccttgcattctttcccacatgagatccacaaacccacccttaacgtctgggacaagaccacttttccagtaatattttcctctggtgactctgctgggacctaaatgaggtgagattccaacccaaaggaaatagactatgcaacaccaattggctgatttgggtaagtggtggaacatatttttatactcgaacagagacactgttcaaaatcggtttagaggcccaacttaggacagttagaggcccttctgacagataagaggtttagaggcctttccgaaagctaagggggttagaagcccttcacaacaagaaatgggttcaatgctacaaaatgttaattactactccctttcaattagccctccctgtgctctctgtcattcactaaagactgtctgctgtctgccaattttctgactgctgactatacttactgtttctttgcagagaccttgcttgatggtcctgagatttttaactttcacgttcctcatttgtctttggattagtggccctttacttgtgtgcttcggcatgttgctaaaagacattagagatgaatggctctgcaagatttactttccctatatctagcccattcgaatgaattatttattgtctcatctctcaaaagattaattgaaatttggtacttacaagttttggtccagtgtgcacgatttagcccagtagcaattatgccaatctcccatgggtgaacagctcccagaaggagaactggagatttctttttggaaattctttttcatcccctcactaatcaactgacctttatttcttgattatgaacagcatgatcatgtaagttttaccctacttaccattactatccttaacctggacattcctctctggatgcatatcatttcccttacttagtgtgacatttctttggtcaggccctctattgtagattctctagttcaggtgactcagctcatttatattatgcgactaacaagaatgccagaattaagtcaactactgaatcattttcccttgcttgtttagctctgaaagctcctttatcctttttagtgaagcttgccctgtggcagcactaccttgttcacaaggatctctaccttcacctgctctgctcctgtgtaatacagctttgatcctgaagagttctgagttctccactaggatgtctagtagagcattggaacaaatttcaattaggtgagcttaagaaaaataaattgacatttttatgtaatactgtttggcctcattatgatttggaatatcaagataaatggccacctaatggaaccacagcctttaatattatacatcaacttgatttgttttgcaagtgggagagaaaatgaggtaaaataccatatgttcaagcatttttattgcttagtcaggatgaaactttacagcaagcgtgtgcatgtttaatgaaaggaaggaaagaaaaggaattagatatactagatgaccctttaatgcaagtcccctgagtccaatgggtgcctttgggtggaacagtacctccctgtgtcagctctaatgcttcaggtgcatctccctctgtctcttctagcccttctagtagtcctgtttagacactttcattcccttctccttacccgtctagtctaattttatacctacctcattctgagaggcccagtcctattctgtaactgtcactccctgaggaggccagccttgctagtactacccagagtggagcctcttctcagtctccaaaggaaaatctttgttggcttagagaagtggcaaatggggaagagcgcactataaggtccctttccccatgttttttttttggtcttatgtaaaggttatttctctgaagacccaggaaaatgtatagataaatttgagaagctaatgctgacttataatttgacctggtaggattttcatattttgttatccacatgttgtacagtggaagaaaaacaatgaattttgggattagctagaatacattcagacaaagtactagcctgcaatcctaatgatatctatagaacaaggggtatttcagtgcctgattaagatctaggattgaactatcaaagaaataggagggcttacagaagagagatcatatgattacttggttattaaaagagaggagagatgtgtgaaaaagtctcttaattattataaggtgaaagaaattactcaaggtaaagatgagaatccagcattatttcagggaaatttggttgaggcaattagaaaatatactaaaattgatcccatttcaatggaaggacaaaccttactggggctgtattttataacccagtctgccactgatgtctgtcagaaactacaaaaagcagcctgggtctgcagacatctatgaatcaacttttcagtatggcatttatggttcttaataacagatacatggcagaggaagtgaaaaacttaagagagcctcctaaaaggcacagtttttagctgcagcattaagcttaccaaccacgtgagatcatccttacacttcttagccatggcaaaggaagctggaaggcagaaagccacaagctggggttctaagcactgcaccttgggtgtaaatcaatgtgctcactgtcataaaattggctattgaaagagggaacacccagcactccaaagtgagtctttggcccctgaacaaatgatggcagttcaagagtgacagggccctagagcttctgtcacagctcccattggacaattagccatatctccagaggagcttcgggtaatcattgatgtgacaggtaacaatattaatttccttttggacatgggtgcttcttactctgttttgactcatcataatgggccattatcatcccaagactctgtggtcatggggataaacggacgagctcatagactccattttccctatcctccaagctgctcttcagggactcttgttttttcgcatgcttttcttataatgcctgaatgtcctactccattttcaggaagagatttatgaactcagctgcaaactctggttttcttcagagatcacaaggcagatgattgattgcttttacttgtctcccatgataagggaagaaaaattaataggagacactctcataatatcttgctatctttacttataccctctttgcagaaagttgaaatttaaaaagggaaaagtaactaggcattcactagaattaggttaactaaaaatttctctgcagagctccttactaggcataggaactacagcaagcatcctgaaggagtctcattagagtgtcttttagacaattgctccaaatatgtccacatagtaaagaaaagatgacacagaacaacatacacaatcaagtatacaaccactacttggtagcattaggggaagttccatggatagatgcttgtaggagctataaaaagaagtggttttggaaggaatcaaaatgagacaaagaccttaaaactaggaaaaaaatgtatctacagagttcagggaatttctgctataaaaattaattgtaacaataaattgtaaaaaaaatgacaagaaaagccaaattgtaatgaaagtgatctgcctaggttacagcagaggcaatcaataaattattctgatgttctcacaatgcagaatatgaagaatgtttgcagaaatcaatacctgttgaagattaactaatgaaaaccaaatgaagaaataaccaactatatacaatatacaatagtatacaactatatacaatatacaatagtttacaatagtatacaactatatactatgtataatagtaacatttgcaccaaaggattatagatatagaaaataaatcaaaatgatgttttataataaacatagttcaaatgtccagagatgaaaaatagttcatataatatatgtatggaaaatgacgagaaccataaacataaaaagaaacacatcaattctagaaattagaaataaactcactggttacactaaaatgtaattgataacatgaaataaaatggaactgaatgaatgaacaaaagaacaaacaataacagcagtagaaagaactagtgaatctttctatttttctccctgaatcttgactcatagagccccaataggaatcacctaatactctaggaattgccactaagctgattaaaatataaaagtgttatttgttaaaaaagaaaaaaaagctgaattagtgctctcccgattgcctgctttattcccaaaactctcttatttctaattgttttactggtcttaatcattcatgctatgtttcactgaagtatttgtgaaatatttcatgtgtttatctcaattttgattttatctcaattttggtttcattctatcttgactcttgcaacctgcatgtcctcattttactttaccaatccagctccaaagacaaccttctcatagacctaggatttctcattaaatttttaccagtttatctgagcttcattgatcttgtttctctgccaattactctgagccactgtcatcatgacctaaaattttttcacaaattacaaatttaccctttataatttatctgtgtcaaggaagactctgtagacaataccagaagaaaaaaatgtgtgcagtacatgaatgaaaaacctgatgtttcctgactttttgatgattgtcattctaactggtgtgagatgatatctcattgtggttttgatttgaatttctctgatggccagtgatggtgagcattttttcatgtgttttttggctgcataaatgtcttcttttgagaagtgtctgttcatgccctttgcccactttttgatggggttgtttgtttttttcttgtaaatttgtttgagttcattgtagattctggatatgagccctttgtcagatgagtaggttgtgaaaattttctcccattttgtgggtggccagttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataatgtgtaaggaagggatccagtttcagctttctacatatggctagccagttttcccagcaccatttattaaataggatgtggagaaataggaacacttttacactgttggtgggactgtaaactagttcaaccattgtggaagtcagtgtggcgattcctcagggatctagaactagaaataccatttgacccagccatcccattactggatatatacccaaaggactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactatcgcaagaacaaaaaaccaaacaccacatattctcactcataggtgggaattgaacgatgagatcacatggacacaggaaggggaacatcacactctggggactgttgtggggtggagggaggggggagggatagcattgggagatatacctaatgctagatgacgagttagttagtgggtgcagcgcaccagcatggcacatgtatacatatgtaaccaacctgcatattgtgcacatgtaccctaaaacttaaagtataataattaataaataaaaaaatgaaaggacaagagtaggaaagtgtaaaaaaaaaaaaagaaaaacctgactgaatcataaacaaaaataggcaattagattaaaaatttagtatttgctaattaaatcaatgatagatttttatatactttggattggtaaaaattaatatcaccataggggaagaaccaactacctggccactccagtgctgtatagagtggcaatagtagaaagatacacacgggctcaacaaactctctctacttaaaactaaggtagctattactgaaatcaaaaattcaacctgctaatatgtaaattctgatcatacctttagagatcagagaagtgaccagtagtgaggctgcagacacaatgaaacaactctaatctcaccttgttatgaactgtatctgctcctgtgttgaagagcttcatttgcgtaagattttgctttttcttcatctgaattttactatgaggcaatgcacaagattttaacaacctatagatactaactgatatgatttggctgtgttcccacccaaatctcatcttgatttgtagcttttataattccatgtgttgtgggagggacctggtaggagataactgaatcataggagcagtttcctccatacttttctcatagtagtgaataagtcttatgagatctgatggttgtataaagggcaacacctcttgcttgggtcgcaatactcacttgcctgctgccatatcagtttcctccatacttttctcatagttgtgaatgagtcttttgagatctgatggttgtataaagggcaacatctcttgcttgggccgcaatactcacttgcctgctgccatatcaatttcctccatacttttctcatagttgtgaatgagtcttttgagatctgatggttgtataaagggcaacatctcttgcttgggtctcaatactcacttgcctgccatcatatcagatgtgactttgctcctccttcctttccaccatgattgtgaggtctccccagccatgtggaactgtgagtcattaaacttcgttcctttttgaattactcagtcttgagcatatctttattagcagcatgagaaagaccaatacagtaaattggtactaggccatagggcactgctataaagataccagaaaatgtggaagcaactttggaactgggtaacaggcagaggttggaacagtttggtgggctgagatgacaggaagatgtggaaaagtttggaacttccttaagacttgttgaacggctttgaccaaagtgtgataatgatatgaatgataaaatccaggttgaggtggactcagatggagttgaggaatgtgttgggaaatggagtaaaggtcaattgcgctatgcaaagagactggtggcatctagcccctggcctagagatatgtggaactttgaacttgagagagatgatatgaggtatctggtggaagaaacttctaagcagcaaaatattcaagaggtgacagagtataaaagttgggaaaatttgcagtctgaaaatgcagtagaaaagaaaaccccattttctggggagaaattcaagttggctgcagaaatttacataagtaatgaggagccaaatgctaatcatcaagaaaatggggaaagtgtttctggggcttatcagagaacttcacggtagaccctcccatcacagattgtagggaaaagaaagagagatcagactgttattgtgtctatgtagaaagggaagacataagaaattccattttgacctgtaccttgaacaattactttgctgagatgccggtaatttgtaactttgccccagccactttgcctcagccactttacctcagccactttgccccaactttgagctcacaaaagcatgtgttgtatggaatcaaggtttaatggatctagggctgtgcaggacgtgccttattaacaaaatgtttacaagcagtatgcttggtaaaagtcatcgccattctctagtctcaataaaccaggggcacaatgcactgtggaaagctgcagggtactctgcccttgaaagccaggtattgtccaaggtttctccccatgtgatagtctgaaatataacctcctgggatgagaaagacctgactgtcccccagcccgacacccgtgaagggtctgtgctgaggtgggttagtaaaagaggaaagcctctcgcagttgagatagaggaaggccactgtctcctgcctgcccctgggaactgaatatgtcggtataaaacccaattgtacagttgttcaattctgacataggagaaaaactgccctatggcagtaggtgagacattttggcagcaatgctgccttgttattctttactccactgagatgtttgggcagagagaaacataaatctggctacgtgcacatccaggcatagtacctccccttgaacttaattatgacatagattcttttgctcacatgctttttgctgacattctccttattatcaccctgctgtccgacacattcctcttgctgagataatgaaaataataatcaacaaaaactgagggaactcagagactggtgccagtgcaagtccttggtatgctgagtgctggtcccctgggcccacttttctttctctatactttgtgtactgtacagtctccaacgggcattatttttcaaaatacagaccttgtgcggtggtcattccttcctcacagtataattaagacttttacattgtatttagatgaaatggctgcattaattggtcaggcaagactatgaatagtaaaatcgtgtggaagtgacccagatgaaatcattgttcctttaaacaaggaacaggttagacaagccgttgtcaattctggtgcatgacagattggtcttaccgattttgtgggaattattgataatcactacccaaaaacaaaaatcttccatttttaaaaattgactacttggattttacctaaaattaccagacataaacttttagaaaatgctctgacggtgtttactgatggttccagcaatggaaaagtggcttacacaggccaaaagaatgagtcattgaaactcaatgtcactcagctcaaagagcagagttggttgctgttatttcagtgttacaagattttaatcagcctattaacattgtttcagattctgcatatgtagtacaagctaaaaaggatgttgagacagccctaatcaaatatagcatggatgatcacttaaaccagctgtttaatttattacaacaaactgtaagaaaaagaaatttcccattttatattactcatattagagcacatactaatttaccagggcctttaaagcaaatgaacaagctgactcgctagtatcatctgcattcataaaagcacaagaacttcatgctttgactcatgtaaatgcatcaggactaaaaaataaatttgatatcacatggaaacaggcaaaaaatattgtacaacattgcattcagtgtcaagtcctacacctgcccactcaggaggaaggacttaatcccagaagtctaagtcctaatgctttatggcaaatggatgtcacatatgtacctcatttggaaaattgtcatttgtccatgtgacagttgatacttattcacatgttgtatgggaaacctgccagaaaggagaaagtacttcccatgttaaaagacatttattatcttgttttgctctcatgggagtatcagaaaaaattaaaacggataatgggccaagatactgtagtaaagcatttcaaaacttcttaaatcagtggaaaattacacataaaacaggaatcccttatgattcccaagggcaggccataattgaaagaactaatagaacactcaaagctcaattggttaaataaaaaaaaggaaaaagagagtagaagtgtaacacttcccagatgcaacttaatctatctagcacactatactttaaattttttaaacatttatagaaatcagaccactacttctgcagaacaacattttactggtaaaaagaacagaccacatgagggaaaactgaattggtggaaagacatgaaaaataagacatgggaaataggtaagatgataacatgagggagaggttttgcttgtgtttcaccaggagaaaatcagcttcctgtttggatacccacaaggcatttaaaattctacaatgaacccatcggagatgcaaaaaaagtgcctccacagagacagaaaacctgcaatcgagcatcatctactcgccaggtgaataaaatggtgatatcagaagaacagaggaagttgccatccaccaagaaagcggagccaccgacctgggcccaactaaaaaagctgacacagttagctgaaaaaagcctgaagaacacaagggtaacacaaactccagagaatatgctgcttgcagctttaatgattgtatcaacggtggtaagtctccctatgtctgcaggagcagctgcagctaattacacttactgggcctatgtgcctttcccgcccttaattcgggcagtcgtttggatagataatcctattgaagtatatgctaataatagtgcatgagtgccaggccccacagatgaccgtggccctgcccaacctgaggaagaaggaatgatgataaacatttccattgggtatcattttcctatttgcctggggaaggcaccaggattcttaatgcctacaacccaaaattgattggtagaagtacctactgtcagtgccaccagtaaatttacttatcacatggtaagtggaatgtcacttgggtcacaaataaataatttatagcactcttcttattaaagatcattaaaatttaggcctcagggaaaaccttgccccaaggaaattcgcaaagaatcaaaagacccagaagtcttagttcaggaagaatgtgtggctgatactgcgatggtattacaaaacaataaatttggaactattatagactgggccccttgaggccaattatattatgattgtacaggccagactcactcatgttcacaggccccatctgtctggcccactaatctggcctatgatagtgatttaactgaaaggctagaccaggtttatagaaggttagaatcaccctatccatggaaatggggtgaaaagggaatttcatcacctcgaccacagttagttactcctgttactggtcccgaacatccagaattatggaagcttactgtggcctcacaccacattagaatttgatctggaaatcaagttatgggaacaagaaatcataagccatattatactattaacttaaattcctttgcaaagttgtggaaaacccccttatatgctagttgtaggtaacatagttattaaaccagattcctaaactataacctgtgaaaattacagattgtttacttgcattgattcaacttttgattggcagcaccgtattctgctagtgagggcaagagagggcgtgtggattcctgtgtccatggactgaacgtgggaggcttccccatctgtccatatgttaacagaagtattaaaaggagttctaactagatccaaacgattcatttttactttgattgcaatgattatgggccttattgcagtcgcagctactgctgtggctgctgtaattgctttacactcctgtcttcaaactgcagaatatgtcaataattggcaaaagaattcttcaaaattgtggaattctcagacccaaatagataaaaaaattggcaaaccaagttaatgatcttagacaaactgtcatttggatgggagattgacttgtgactggaatatgtcagatttttgtattaaacctcgagcctgtaatgaatctgaatatcactgggacacggttagacaccatctacaaggaagagaagataatattaccttagatatttcaaaattaaaagaacaaatttttgaggcatcaaaatcccagttaaatctggtgccagaaactgaggaaatggtgaaagctgctgatagcctcacaaatcttaaccccgtcacttgggttaaaaccattggaagttccactattgcaaattttgtattaatccttgtgggtctgttctctctgttgttagtctacaggtgtatccagcagttccagagagacagcgaccagtgagaatgggccatgatgacgatggtggttttgtcaaaaagaaaaaggggatatgtagggaaaagaaagagagatcagactgttactgtgtctatgtagaaagggaaggcataagaaattccattttgacctgtaccttgaacaattgctttgctgagatgctggtaatttgtaactttgcccagccactttgccccaacttcgagctcacaaaaacatgtgttgtgtggaatcaaggtttaagggatctagggctgtgcaggatgtgccttgttaacaaaatgtttacaagcagtatgcttggtaaaagtcatcgccattctctagtcttgataagccaggggcacaatgcactgcagaaagcgcagggacttctgccgtggaaagccatgtattttccaaggtttctccccatgtgatagtctgaaatatggcctcatgggatgagagacctgactgtcccccagcccgacacccatgaagggtctgtgctgaggtggattagtaaaagaggaacgcctcttgcaattgagatagaggaaggccactgtctcctgcctgcccctgggaactgaatgtcttggtataaaacccgattgtacatttgttcagttctgagataggagaaaaaccaccctttggtgggaggtgagacatgttggcagcaatgctgccttgttattctttactccactgagatgtttgggtggagagaaatgtaaatctggcctacgtgcacatccaggcatagtacctccccttgaacttaattgtgacatagattcttttgctcacatgtttttctgttgatcttctccttattatcaccctgctctcctactgtattcctcttgctgagataatgaaaataataatcaataaaaactgagggaactcagagactggtgccagtgcaggtccttggtatgctgagcgccagtccactgggcccacttttctttctctatactttgtctttgtgtctgatttcttttctcagtctctcatcccacctgatgagatataaccacaggtgttgaggtgctggccaccccttcacacctatggatatatcttgacaggtgggtcacacaaattgggaaaatttgcagtagaaaagaaaaccccattttctgggcagaaattcaagttgtctgcagaaatttatgtaagtaatgagaagccaaattctaatcatcaagaaaattgggaaaatgtttctggggcatatcagagaacttcacggcagaccctcccatcacaggcctggagtcctaggaaggaaaatggtttcacaggccaggcctagggccccccatgctctgggcagcttcaggacatgatgtccttcatccaagctgtttcagctccagccatggctaaaaggggccaaggtatagctcaggccattgcttcagagggtgcaagccccaagccttggtagcttttctggggtgttgagcttgcaggtgtacagaagtcaagaactgagttttgggaacctgtgcttagatttcagaggatgtatggaaatacctagatgtccaggcagaagtttcctgcatgggcgggaccctcatgcagaaactctgctagggtagtcagaagggaaatgtggggttgaagtcccaacccagtgtcgccactggggcaccacctagtagagctgtgagaagagggccaccatcctccagaccccagaatggtagattcactgatagctttcactatgtgcctagaaaagctgaagacactcaatgccagcctgtaaagtagcagggagggaggccctaccctgcaaagtcacaagtgtgaagctgcccaagaccatgggaacccactacttgcattagcgtgacctggatgtaagacattaagtcaaaggagataattttggagttttaatatttgactgcccctctggattttagattcacatgaggcatgtagcccctttgtttttgtcaagttctcccatgtggaatggctgaatttacccaatgcctgtactcccatgtattgaggaagaaactaacttgtttttgattttacaggctcataggtggaaggaacttgccttgtgtcagctgagactttggactgtggacttttgaattaatgctgaaatgaattaaggctttgggggactgttggaaaggtatgctttgttttgaaatgtgagggcatgagatttggagaggctgagggcggaatgatatggtttgtctccacccaaatctcaccttgaattgtagctcccataatttcatgtgttgtgggagggacctggtgggagataattgaatcatgggggcaattttttccatactattcttgtggtagtgaatgagtctcaatagatctgatttttttttttttttttttttttgagacggagtctcactctgtctcccaagctggagggcaatggcacgatctcggtttgctgcaacttccacctcctgggttcaagccattctcctgccccagcttcctgaacagctgggactacaggcacatgctggtacatccagctaattttttgtattttttttttagtagagatggggttttaccatattgcctgggctggtctcaaactcctgaactcaggcaatccgcacacctttgtctcccaaagtactaggattacaggtgtgagccaccacacctggcctgatctgatgattttataaaggaaacccctttcatttgggtctcaatgttctcttgcctgccaccttgtgatatgtgaatttgctccttcttgccttctgccatgattgtgaggcttccccagccatgtggaactgtgagtctgttaaacctctttcctttataaattactctgtattggatatgtctttattggcagcacgagaacagactaacacagtaacaaatgagaaatttataatattgttgtctgctataccacttttcaatttgttgaaggtggagatttttaagcagtaggaaatccttagatggttattacaaaataggatgattataatgaaaattaatgtgcttaaaataaaggttttaatacaatatcatcagaagttgggagaattaatggaacccctagaaagttcccgaaccctcagacttccaagccaatctgctccatttatcacagtttggagtagtttacaaagcacaaatgcagaaatcacaatgtgaaaatttattaacgctttcctcagataatattgagatattaatcaagataaaagtttgcaaaaaggcaagcgtctcttggctcaatcaccttgtacagacacaaaacacattaagtcctaatagagcctaagtaaaggttaatgaaatgaagataaaaggttatagaaaagttggtatatatccacaagctttatgtgaagtagttacatctcttttatctgacagtattattagaatggacattgtatctaactgggaaatgtttcccacatctagtattatacaatggaaggcatccaaatttgtctttaaatcattatgaattgggcattctaaatagaagccagtaagatattccatccaagttcatacagtgtagaatagaagctggagtgctgatagaaaaaaattctctgttcgatagccctatatcaagcataacttatagtaatatgctgtgagtatctcccagtgataaatactgggatttgggaaaggagaatttccacttgagtggcatttactaccttgctgtagtacattaattgaagctatccataacagttcatcaaataaccttgaaacatgaaatacccatgatgtcttgcataatgtaaatgaaacactccagtcatatagcagtacccagaagagttttgtactacaatggaaattgtctatatagaatcaaactgcgtcatgaatgcctgaaggagatattcttaagctcagaacccctttcctcctaggactgattctgaaactgtgtgaggagttgcctaattccacagtgctctataaatagctcacaactgactgacaaagatctgctaggcttgtagatggcacttacagggtgaatgaacaaactactgccatattgattctttttttctagttcttatgtaaatcctttttaaaaaaagggtttttttttttttttttttttttttttggaatggtctcactctgttggccaggctgaagagcatacaattacagtttactgcagcctcagcctcaaactcccaggctcagatgattcaccaacttcagtcccccaagtagctgggactacaggcatacatggccatgcctgacatttttaaaaagctttatttgtaggtatagggtctcactataatgccctggctggtgttgaactcctaggcttaagtccttctctcaccttagcctcctagaatgccaagattataggtgtgagctgctgctgtatctggtctgtaaatccttttttctgtcttcatcatttattggcttccttggaattaagggattatcttgttgtatgtttttatttcttcctttttatttttagggtatttattataggtgttctgtgcttatcataaggcttacatgaaaacaccttcttttttattatactttaagttctagggtacatgtgcacaacatacaggtttgatacataggtgtacatgggccatgttggcttgctgcccccatcaactcatcacttacattaggaatttctcctaatgttatatccctcctccagccacccacccccaacaggccccagtgtgtggtcctctgccctgtgtccaagtgatctcattgttcaattcccacctatgagtgagaacatgcattgtttggttttctgtccttgtgacagtttgctgagaatgatggtttccagcttcatccatgtccctgcaaaggatatgaactcatcattttttatggctgcataatattccatgctgtatatgtgccacattttcttaatccagtctatcattgatggacatttgggttggttccaagtctttgctattgtgaatagtgctgcagtaaacatacgtgtgcatgtgtctttatagtagcatgatttaaaatcctttggatatgtacccagtaaagggatcgctgggtcaaatggtatttctagttctagatccttgaggaatcgccacacagtgctccacaaaggttgaactaatttacactcccaccaacagtgtaaaagcgttcctatttttccacaccctctccagcatctgttgtttcttgtctttttaatgattgccgttctaactggtgtgagatggtatcttattgtggttttggtttgcatttctctgatgaccagtgatgatgatcattttttcgtgtatctgttggctgcatagatgtcttcttttgagaattgtctgttcgtatccttcacccactttttgatggggttgcttgtttttttcttgtaaatttgtttgagttctttgtagattctggatattagccctatgtcagatgcgtagattgcaaaatttttctcccattctgtaggttgcctattcactctgatggtagtttcttttgtcatgcgcaaaagctttttgtttaatttgatcccatttgtcaattttggcttttgttgccattgctttttgtgttttagtcatgaagtccttgctcatgcctacatcctgaatggtattgcctaggttttcttaaagggtttttatggttttaggtctaacatttaagtctttaatccatcttgaattaatttatgtgaaaagtgtaaggaagggatccagtttcagctttctacatatgtctagccaattttcgcaccaccatttattaaatagggaatcctttccccattgcttgtttttgtcaggtttgtcaaaaatcagatggttgtagatgtgtcgtgttatttctgatgtctctgttgtgttccattggtctacatctctgctttggtatcagtactatgctattttggttactgtagccttatagtatagtttgaagtcaggtagcaagatgcctccagctttgttatttttgcttaggattgtcttggctgtgtgggctcttttttggttctatatgaattttaaaatagtttttttccaattctgtgaagaaagtcattggtagcttgatgggaataccatcaaatctataaattaccttgggcagcatggccattttcatgatatttattctttctatccatgagcatggaatgttcttccatttgtttgtatcctcttttatttcattgagcagtggtttgtagttctccttgaagaggtccttcacatcccttgtaagttggattcctaggtattttattctcttagcagcaattgtgaatgggagttcactcatgatttggctctctgttggtctgttattgatgtttaaaaatgcttgtgatttttgcacgtccattttgtatcctgaaactttgctgaagttgcttatcagcttaaggagattttgggctgaaaagatgggtttttctaaatataaaatcatgccatctgcaaacagagacaatttgacttcctcttttcctaattgaatactctttatttctttctcttgcctgatcaccctggccagaacttccaacactatgctgaataggagtggtgagagagggcattcctatcttgtgctggttttcagagggaattcttccagtttttgcccattcagtatgatattggctgtgggtttgtcataaatagctcttagtattttgagatacgttccatcaatacctcgtttattgagagttttagcatgaagagttgttgaatttcattgaaggtcttttctgcatttattgagataatcaagtggtttttcattggttctgtttatgttatggattatatttatttatttgcatatgttggaccagccttgcctcccagctgacttaatcatggtggataagctttttgatgtgctgctggattcggtttgccagtattttattgaggatgttcgcattgatgttcttcagggatattggtctaaaactctgtttttttgttgtgactctgccaggctttggtatcaggatgatgttggcctcataaaattagttagggaggattccctccttttctattgattggaatagttttagaaggaatggtaccagctcctctttgtatctctggtgaaattcagctgtgaatccatctggtcctggactttttttcattggtagcctattaattattgcctcaatttcagagtctgtttctggtctatgcagagattcaacttcttcctggtttagtcttgggagggtgtatgtgtccaggaatttatccatttcttctagattttctagtttatttgcgtagaggtatttatagtattctctgttggtagtttgtatatctgtgggatcagtggaggtatcccctttatcattttctattgagtctatttgattcttctctcttttcttttttattattcttgctagtggtctatcaattttgtcgatcatttcaagaagccagctcctggattcattgattttttggaggtttttttttgtctctatctctttcagttctgccctgatcatagttatttcttgccttctgctagcttttgaatttgtttgctcttgcttctctagttcttttaattgtgatgttagggtgtcaattttagatatttcctgctttcttttgtgggcatttagtgccataaatttccctctacacactgctttaaatgtgtcctagagattctggtacattatgtctttgttctcattggcttcaaagacatatttatttctgccttcgtttccttatttgcccagtagtcatgcaggagcaggttgttcagtttccatgtagttgtgcagttttgagtgagtttcttaattctgagttctaatttgattgcactgtggtctgagagacagtttgttgtgatttctgttcttttacatttgctgaggagtgctttacttccaattatgtggtcaattttagaataagtgggatgtggtgctgagaagaatgtatattctgttgatttggggttgaaagttttgtaaatgtctattaggtcttaaacttaaagtataatttaaaaaaagaaagtaaaaagatgataatccacttcatgaaaacacacaaaattatataactcactcatagagccaacagacaaaggagaaagaaaaaagaatcaaactttatcagtatagaaaactaccaaactgtcaaaaataagtaataagagagaaattaaggaataagggttatacaaaataaacagaaaaaataaaagaataagcctttacctataaatacataaataaataccttgaaaataggtggattaaattatacaactcaaaacatagactaatggattaaaaaacaagacccaactatatacagcctaaaagaaactcatctcacctataaagttacacatagactgcaattgaaaagatgaaatagatatgctatgcaaacagaaacccaaatcaagcagaaatagcttcacttacataagcaaaacacaaactttaagccaaaactttaaggagaggaaaagagagacttaatatgataataaatgaatcaattgttcaaaaagacaaaaatgtaaatatatatgcaaacaaccatgaaccattgagatatatgaagcaaatattattatacctgaaaggagagatggacctaagttcaataatatttgaggatgtcaccaccaccttttcagcattggacagatatttagacaaaaaatcaatagaaacacatgagatttatactgtaccatagaccaaatcgaagtaattgacatttacagaacattttatccaacagctgcagaatataagattctttttatagcacatataacatccccagaattaaccatatatgaggacattaagcaagtctcaacaaattttaaaaaataaaaattttactaattattttatctgaacacaatgaaataaagtataaaatcaatgacaagacaaaactagaaaaatccatgaaaatttaacaacgtattccttataaccaataggtaaaaaaagaaacaattttaaaattacttaaaacaagaaaaattacatcatgcgatagcaaaatgtatgagattcaacagaagcactattaagagacaagtttagaacaagaaatgcctacatgaaagaagtagaaaagtttcaaataaacaacctaatgatctctctcaaagaactctaaaaataggaacaaaccaaaaccaaaattagtgtaagtaaagaaatactaaaaattagagagaaaaaatgaaattaagactaaaaaagatgaaacaaaatgctaacttttttaaaagacaaaatcagcaaggcattgactagactaataaagaaaaacaagaaaatatccaatttaataaaatcaaaaacagaacaggaaacttcacaactgatacagaaatacagcacatcattaaagattgtaatcagcaactacacaacaaatttgaaaacctggaagaaatggatacatttcttgacatatacattagactaagataaaaacaacaaaaaatataaatcttgcacagactaatactgaataacaacattaaatcagtaacaaaaagccctccaataaataaaagtccaggactacctggagtcacaactgtattctaccaactttaaattattatgctaactacagaaaccagttacaaaaaacacatcttgtgtgattccatttatatgaagccctcaaaattggaaaatgtatagagacagaaagtagattagaggttgtccagggttgagggataaggagatgctaaggatacgaggttagttaaggatgatgaaataatgtaaaattgaacatcacgatagtcacacaaattctgtgaaaatacaatgagccactgaattgtcttggctttaaattagtaaactgtattatatgtcaaatatatgtcaacaaaacttttacaaaacaaataaacaaacatcccttggaccatgatatctaagaaagtctgattcagctgtgtaagtactttaggcctacgccaagcagactgcagacacaaagcacctcttgctatccactgttcataacatgattctaaactttcttatatcacataggtgatttgtatttgcaagataatcagaacttaaatggggaaaagcatttgtaattgttaaaagagatattaaacacatcatataacacaaggtcatctagatttcactttttccacttgccatgaagatactctgaccattcaaataatgtacttacattgatatgtagtagttatattttaaattcttgacaatctcttctttaatataagcaagataaatggtacagggataaaatttgaaaggaagtaccgcatttaatcaggatgtctatgaaatgaatttcagctctactatagctactgctgagttttttcctcaactctggaagtcgtgaaaaggtgctgatgtagctatggaatacagtcattggatcgatttagaggcaaaactggatgaacttatccagatgaatcatgagatcattgtgagaccatcggcttccatttttcttgatctcagcaaaccatttgctattaccttggaatttaattctatatctttattgaaagaaaacttaaaggattattgtctcagttaataaatataattggtggaaagatatattttagacatttatttcattcatcaaaaaatattttgcaaatattttgtttattttaaaagctctgtcagatgttgttttacaaatagaaaagtatcgcaggcttatggattggaaaaataaatattgtgaaaatgaccatactgcccaaagcaatctacagattcaatgcaatttctattgaattatcaatgtcatttataagataattataaaatataattctaaagtttatatggaaccaaaaaaagaacccagattacaaaggaaatcctgagcaaaaggaacaaagctgatggcataacattacctatcttcaacatatactacaaaactgtagtaaccaaaacagcaaagtactggtataaaagtagacacatagaccaacagaacagaatagagaacccagaaataaagccaaatacttaaaaccaactgttcaacaaagcagacacaaacatgcacaaaggaaaggacactctattcaaaaaattgtgatagaaaaaaaggagagccacatgcagaagcgtgaaactggatgactatctctcatcatatgcaaaaattaactgaaggtggattaaagacttaaatgcagaagaaaatataagaaatactcttttggacattgacctacacaaagaatttatgactaaagacacaaaaagaaaagcaacaaaaccaaaataaagaaatgggactttaaaaagcttctgcacagcaaaagaaataatcaatagagtaaacagacaacgtacagaatgggagaaaatatttacaaactctatatctgacagaggattactaatcagaatcaacaagtaactcaaacaaatcagcaagaagaaacaatcttataaaaaatgggcaaatgacatgaatagacatttctcaaaagaagatatacaaatggtcagcaaatatggaaaaaagctgaacatcagtaaccatcagggaaatgcaaattaaaaccacaatgagatatcacctgactaatggtatactcttatcagaatgattgtattttaaaagtcaaaaaaagtagatattggcgcagatgtggtgaaatgggaacatttaaacactgttggtgggaacataaactagtacaacctctgtgaaaaactgcatggagatttctcaaataactaaaagtaggtaaaatatttgatccagtaatcttactaccagttacctacacaaaggaaaggaagtcattatattaaaaagacatctgcactcatatgtttattgcaacaaacttcacaattccaaagatatggaatcaacctaagtgcccatcgacagatgagtgaataaagaaaatgtgatctatatatcacatggatatacacggccacatctcacaggaaaaattccagatcatccatgggaacttccccttacctcagcgcctttggggactttgaccaaaactaggaaggctgcatcagtagggaaaagatgctttccttttcctgtgcttcagctccttgctgggagtctacatgggttttgtacacagtttccaggagggcaactcctagagtgcagtagcctgctgccactgcgaagccctgatcctgggcatctataagcagggcctcaactgccaagccagtggtatgagctgccaccagcagtgcaaggattgcctgtaagttgagcaccagtgcaggccccagagtgtgggcctggaggagtctccacgtcaccctcacacactcatacccaccatcatcccaccttcagcttctccctgccctgccatggcaaacgagactcccagcctccagagattcatgaggaggagatgcagatggtgaaggatggggtgtttgacaactgcttgtaattgatgctatgattggatcaaggactcattcctgccttggagaaaagacttgaaccagagcagggagcctgggggtgctgggacagaaggttggggctgagggcagaatgtgatggtggcatgcagctaagggcagggccagggcaggcgtccctaaggttgtaccaacttttgtgaatatttgtattttcctcatggaataaaaaggctcatgtaattaatctccatatatatatacatttatatatgtgtatatatacatttatatatatataaatgtatacacacacacacacacacacacagaaagagagtagtatatacatacacagcatacatgcatatatattcccttttttctgggagtttttccactcatttccattcaccaaagcaatgcctttgtgccatgtacgtgaagaaatattcgtctgctctagcaaagacctcatctggcacagaagctgtcagggaaacaactacttggttgaatttgcaggagggaaaaggggagacttctttgagatccctggtttttttaatgaagactttatatggcttaccctgtgagaaatgttaaatttctggacaatccttggctaaccagatctgtatattagtacgttccaagttgttcagcagaacagcagacaaattacttttatttttaatttcaatactctttgctttagaaacaattttgctgtggcacttcctagtctgtgactctgtcttgaaaagggctggaactcaggctgcgtagacatacatatttcatttatctggtcttcaacttaaacattcacctctttataaaaacttctctgtaattctgaaggtaattcccctttttttgatggagttcaaaaattgctgacttgcactgttgggaaatcatcactgactgtgatttcattttccatactttcatatttacatccacctgctttttctgttcagtgggagacaagcagttggagccaaccttctgagcttcttcaaaaaggctatcaacaaaatattcacaatttgttgattatcactgagagattgattgtcagatactgtttcacaaacccatcttcttttatactttcgagattatctacctctttcattctcttttgtcttattctgggcagggtctcctggcctcagcctcactcagctcagaggccacgagcaccctttggccccgggctccgtctggagcccgctgctccagacctccttaggttccgccgcggcacagctaggatcctgacggactctctaggtctctgccaggcaccagacaccaaaagcatgctgatgtagtctcaattgatttgtttttaaattggtaattaaacctccacctttattgaaagatcatttggaagattttgttctcatactcggtcagttaataaacatatgatttgtcaaaagatagattttagaaacattttatgaattcaaaaaatttgagggaaatatttgggttgttttagaagctctgtcaagatgtagttttaatcaagaaacttatgtcaaaagtttaagaatcaagccttaatattattcttgcagatgtccttggtaaaatctgctggtggggataattaaaatacacattgtatatactttgtatttcctttttggccttttttttttttttaatggagtctaactgtcacccaggctggagtgctagagtgcagtggcacaatcttggctcaccacaacctctgccttccagatggaagcaattctcgtgcctcagcctcctgagtagctgggactacaggtgtgccccaccacgcctggctaatttttttgtatttttattaaagatggggtttcaccatgttggccaggctggtcttgaactcctgacctcaggtgatctctctaccttggcctcccaaagtgctgggattacaggtatgagcccctgtgcccagcccagtgtggagcttctattcactcctttctatgtacctgtggttctgtcagaattaagtgatcaaataacataaatggagatggtaaaaaaatgtgataagacatcagaaagatagtgggatagaaagccagcaactcatgtctccccttgcaacaataagaatttttcacacaaccacagataaaagactctttagttttggtattcaggtaggatgttgtgaaacccctgtgtagcccaagacctagcaagggcattttgagaatacataacagaactcaggtattagactcacttataatgccagaaacagccccatttcccaaaaagcttgtctacagccctgtttggccttgagcctgtaatcaaaattatcttcccaggagtccaggaggaatcatactcactagtgccttagcagaaaagcttatctgtccaccaacattggtctcagcagcagaattgacagttatcctgtaactcaggggaaaccccttcagttgtggtgccagattattactgcttgggcaaggacatagaagcagatttacccatgtctttcagtccagtaattacctgttcatctgagtgtgtgacaggcctgtcaatcttcattcaaacacaaattatgaggaagcctagtttcagctctagcccttctggctgcagttggagaactatcctacccacataggaaagtgctgggggttgcttgtccacctgctaatgaggtcggctcaccatcctccttctgcagtaagtccctagggagcccagccccagctccaaccttcctttctgcagtcagggaccttccctgctcgtgcagaaaactattgggaagcacatttgcctgggccaccatccaggctcaccagtctctgctcccagagcatattctgggagtgggaagggcagtctcgactcaaacccctcttgctacattcaaagaactgcttctacttttcaagaaagacaaaagagacaagagacaaaagagcagaaggctattcaaagaaataatagcggaaaactttcataacttggagaagatataaacatccaggtagagttaggtaaaattaaccgataagatacaacataaataagattactctaatatatattataatcaaactctcaaaagtcaaagacaagctgctgaaagcagcaagataaaagaagtaaaatgcatgtaaaggaattacaagacatctggcaacagacttctctggagaaaccttgtcagccatgatagtgtcagacaatacattcagagtacctaaggcaaaacaaaacaaaacaaaacaaaacaaaacaaaacaaaacctgccaatcaaaaatactgcatccagtattagaaatgctatcctttagaaatgaagtagagataaagactttccagacagactgagtaaatctagcatcaccagacatgtcctacaagaaatacaaaaatgagttattcaaactgaaggaaaaagatgtttttgcataacaagaaatcatctgaagacagaaacttcactggaaaatgtaagtaggaaggcaaattcagaatactctaatactgtaattgtagtgtgtaaaccacttacatcttcagtataaatactaaaagacaaaacaataaaaagtaataataactacaaaaatttattaagagattggaaatataaaaaatgtaaattgtggcatcgaaaacttaaaatacaagggaatattacagttaaagtatacaggggttttttttgcttctctttcaaatcaaagataattgtattggtttaaaataactttttataagatatttttctctccattccaagatggctgaacaggaacagccccggtctgcaactcacagcatgatggatgcagaagataggtgatttctgcatttccaatggaggtacctcgttaatctctttgggactggatggacagtgggtgcagcccacggagggtgagctgaagtgtaaggggtcagggtgtttccctttcctagcaagggaagctgtgacagactgtacctggaaaaatggggcactcctgcccaaatattgcacttttcccagggtcttagcaactggcagacaaggagattctctcccgtgcctgacttgggggggtcccatgcccatggagccttgctctctgctagcacagcagtctgagatcaaattgtgaggcaacagcctggctgcaggaggggtatccatcattgctgaggcttgagtaggtaaacaaagcagccgagaagcttgaactgggtggagtgcatggaagttcagcaagccctactgcctctagactccacctctgtggacaggacatagctgaacaaaaggcagcagacaacttctgcagacttaaacgtccctgtctgagagctctggagagagcagtagttctcccagcacggagtttgagctctgagaacagacagactgccttctcaagtgggtccctgatccctgtgtagcctaactgagagacatctcccagtaggggccaacagacacctcatgtaggtgggtgtgcctctggtacgaagcttctagacgaaggatcgggcagcaatatttgccgttctgcaatatttgctgttctgcagcctccactggtgatacccaggcaaacggggtctggagtggacctccagcaaactccaacaaacctgcagctgagggacctgtctgttagaaggaaagccaacaaacagaaaggaatagcatcaacatcaacaaagaggacctccacaccaaaaccccatctgtaggtcaccaacatcaaagaccaaaggtagataaaaccacaaagatggggaaaaaccagagcagaaaagctgaaaattctaaaaatcagaatgctacttctcctcaaaagtatcacagctcctcaccagcaacagaacaaagctggacagagaatgactttgacgagttgatagaagtaggcttcagaaggtcgttaataacaaacttctctaagctaaaggagcatgttcaaacccattgcaaggaagctaaaaaccttgaaaaaaaggttagacaaatggatagttagaataaacagtgtagagaagaccttaaatgacctgatggagctgaaaaccatggcacgagaacttcgtgatgcatgcacaaggttcaatagctgaatcaatcaagtggaagaaagggtatcaatgactgaagatcaaatttatgaaataattgtgagaagacaaggtaagagaaaaaagaagaaaaagaaatgaacaaagcctgcaagaaatacaggattgtgtgaagaggccaaatatacattagattggtgtacctgaaagtgatagggagaatggaaccaagttggaaaacactcttcagtttattatccaggagaacttccccaacctagcaaggcaggccaacattcaaattcaagaagtacagagaacaccataaagataatcctcgagaagagcaaacccaaggcacataattgtcaggttcaccaaggttgaaatgcaggaaaaaatgttaagggcagccagagagaaagatcgggttacccacaaagggaagcccatcagactaacagcagctctctcagcagaaactctacaagccagaagagggtgggggtcaatattcaacattcttaaagaaaagaattttcaacccagaatttcatatccagccaaactaagcttcataagtgaaggagaaataaaatcctttacagacaagcaaatactgagagatcttgtcaccaccagaactgccttaaaagagctcctgaaggaagcactaaatatggaaaggaacaactggtactagccactgcaaaaacatgccaaattgtaaagaccattgatgttaggaagaaactgcatcaactaacaggcaaaataaccagctaacatcacaatgacaggatcaaattcacacataacaatattaaccttaaaggtaaattggctaaatgccccagttaaaagacaaagaccggcaaattgaatagagtccagacccatcagtgtgctatattcaggagacccatctcacgtgcagagacacacataggctcaaataaagggttggaggaagatctaacaaccaaacggaaaacaaaaaaaagcaggggttgtaatcctagtctctgataaaacagactttaaatcaacaaagatcaggagacaaagaaagccattacataatgataaagggatcaattcaacaagaagagataactattctaaatatatatgcactgaatacaggagcacccagattcataaggcaagtccttggagacctacaaagagacttaggctcccacacgatagtaaagggagactttaacaccccactgtcaatattagacacatccatgaaacagaaggttaacaaggatatccaggacttgaactcagctctgcaacgagcagacctaatagacatctacagaactctccacccaaaagtcaacagaatatgcattcttcttggaaccacatcacacttgttccaaaactgaccacatagttggaagtaaagccctccacaacaaatgtaaaagaacagaaataacaacaaactgtctctcagaccacagtacactgaaattagaactcaggattaagaaactcactcaaaaccacacaactacatggaaactcaacaacctgctcctgcatgactactgtgtaaataacaaaatgcaggcagaagtaaagatgttctttgacaccaatgagaacaaagacacaatataccataatctctgggacacctttaaagcagtgtgtagaaggaaatttatagtactaaatgcccacaaaagaaagcaagaaaaatctaaaatcaacaccctaacatcacaattaaaagaactagagaagcaagagtaaacacattcaaaagctagcagaaggcaagcaatacctaagattagaacagaactgaaggagatagagacacacaaaaaaacccttcaaaaaaatcaatgaatccaggagctggttttttgaaaagatcaacagcaagtattgtagaacagcaaacattgctgcctgatccttcctctggaagcttcatctcagaggggcacctggctgcatgaggtgtcagttggcccctactcagaagtgtctcccagttaggctacccaggggccagagacccacttgaggaggcagtctgtccatttcagagctcaaacaccatggtgggagaaccactgctctcttcagagctgtcagacagggatgtttaagtctgcagaagcttctgctgccttttgttcagctatgccctgccagcaaaggtggagtctacagaggtaggcaggcctccttgagctgtggtgggctccacccagttcaagcgtcctggctgctttgtttacctactcaagcctcagcaatggcgaatgcccctcccccagccagtctgcctccttgcagttggatcttggactgctgtgctagcagtgagcaaggctccatgggcatgggacccactgagccaggcatgggatgtaatctcctgggtgtgtcatttgctgagaccattggaaaagtgcagtattaaggtgggagtgtcctgattttcctggtagagtctgtcatggcttcccctggctaggaaagggaaatcccccaaccccttgcacctccggggtgaggcgatgccccgcccagcttcagcctgccttccgtgggctgcacccactgtccaaccagtcccagtgagatgaaccaggtacctcagttgaaaatgcagaaatcacccatcttctgcattgatcatgctgggagctgcagaccagagccgttcctgttcagccatcttggttcatcactatagacacgttacaaaggaagatatacaagcagccaacaagcatatgaacaaaaaggtcaatatcactgatcattagggaaatgcaaattgtaaccacagtgagataccactgatcattagataaatgcaaatcaaaaccacagtgagatactatttcacacaagtaagagtggctataattagtcaaaaaatagcagatactggtgaggttgcagagcaaagggaacatttatacactgttggtggaagtataaattagttcaaccattgtggaaagaggtgtggtgattactcaaaaagctaaaagcagaactaccatttgacccagcagtcctattactggatatatgcccaaaggaatatgtatcattctaccataaagacacatgtacatttatgttcattgcagcactgttcacaataggaaagatatggaatcacctaaatgcccatcagtggtagactggataaagaatatatggtacatatacaccatggaatactatgcagccataaaaaagactgagatcatgtactttgcaggcacatggatggagctggagaccatcatccttagcaaactaacacaggaacagaaaaccaaatgctgcatgtactcacttatgaggaggagctaactgatgagaacacatggatgcaaagagacaacagacactggggtctacttgagggtggagggttggggagaagaataggatcagaaaaaataactattgggtcctaggctttgtacctgggtgatgaagtagtctgcacagcaaactcccgtgacaggagatcagctatattagaagcctgcacttttacccctgaacctaaactataagttaaaaaaaaaaaacttaataaagaaacgtaaagtcaaaagttttgtgactattatgtcaaaattatgtgcttatcattttgctgctattccttttttaaaaaatgcatttttttctctctctgtaaaataatggtgttccctttccaatgcaaacatactttcagatcctaatcattggggtaaacattctttttaaaactactgtttacaaaagtaaaaatctgactttgtccatgcagatcatctattgacaagtatttttcaacagcataattttaaccttaagacatcagttttaatagcagtcattacattattattccaggtgattcatgggacacctgagcactctgtataattgaagttatctgtagccacatttaatatgacatgttcaatgtttggtctcacaagctcactgcttagagtcttcttcatccacccaatattgaagtaatgaaatggctgttaatagattcatcactgatctcattctgtgacatctttatcagaataatataaaatcaatgtaagaaattttgtgaaattatgaaaatttagaaaaaaataaatttcatttataaaatctgtgtgctttcattatggttttattctatttatataactcaatgtacatatattatgtttatataaaatctttttatctcattgcatatgtcttttcttccgacacaaaaattgtgatatttttctgttcatcattatgttgcatagtattcaacaatacctgtactatggctgacagtgtaatttaacattttttgataaaacaattgtaatggcatggtacacacattgtatacattttaaatcatttctcaatgtaaaatatttgaattgtctccagtgtttattttatgaatgtctgccacaaatattgaatctgaccatcgtgatttagttgttctctgtatagtttcatatgagtatattatgaagccaatgtctatgtgcatttttataatacttaatacttttccccaagtgtctgattcttttaaaatatgcaaacattatctgagaatctaatgcataatggaaaagcaagcaaatttgtgacaacaattattttatgtaagaaggaattagaggacaggctgcacaactattgacttggattggaacctaccttctgcaaatgaataacaacagctagtattagtatttatcaccattgtactaatagtcattcttgcccttgtcttccttctccacctactctcttcccccttctaatggcaccatcactttcctctattgcgaaaggggaaattttttgagaataaggttagagtgcatagaattttcattggtcctacctctgcctttgtcctttgggaaattaccacatagagcctatgcaattttcattcagcataaacattgggatttaactcgactaagatttcagttttctgttgttgctaataagaaggtagacaaaaagatctcttaagacttatataataaagtagtgaggaatgcttgctttctacttatgtctcaaaagaataacattaaagtaaaatatatgaggttcttttgtttcttcataaggaagatcatcctatatcctggcataattctttgataaatctcagtgtagttttcagatgcaagtggtagacattatttggatcttattatacatgcattgttcattttttttttggtgcttctctgtcaggcagctgtgatgatgagtcccaagtttcccagagatttttactgaggtgtcctataggcgtggcataaggcagaaaacattaaaagggtaaactgacccttttatgctctaagatataaacctctgtgatctcactgacgaaagttttaaatgctagagtgaaagcaagtaaacattggctttggctgagaatattctggtggcacacatttatgtcgttgatgaatagtgtaccttgaaaagccttaacccttacatcgttagcatttcatcttgttcatctgactgcccaaaaatctatatttaaacaagtccacaggggatctgttctctaggactttgctggagaaccttgatgtgttggaaaactgttcctattaatagaaaaattatatctcgagtggctggcatatgttaactaatggatactattaatagtaataacaaaaataaaaaatcattacaatattactactatttgaatcactatgtacgagagacattataagtgttttatctgtattaagtatattttcaacacaacacaataggaagaaattgccattattatagaagtaggcataattatctctatcaacattctagtccacttttccattatctgttgcataaactcatgcaaaatcttctaaatgatctacacttttcacaatctggcctttttgtgatgtaatccattgacaacattgagagctttttaaagaaagggaatctgatcacatctctccatttcttaactctgtgcagtagctccccattgcccttaatagacacttcgatctccttataattatattgcttccacttacctctctagcaacatctgctactttactcagctttttcctgcatactaattagaaatcttaggaactgcctttacttcactacctgcttttctttttttgttttcctctccccctcttcttttcacctattcctgcacattactgaggactcactttaccaatgactttgagatctcttctagatgtttgcttagcattgtgaccttataacacttttagacttttcctttttacttgcttatagtctatctttcaaagtacaacgtaaggcatgagggagcagaaagtgcctacatttcttctctgaaaatcgagcacttatccatggtttatgctgatcacttcataaacattctttgaaggaatgacttatactttttttttactttgcacaatgaaggctttcattgaatcaaccctgttttcagagtctctttagtatccctctttgatatttaatgacactaaagtttacacagttgtgatgatatagaaacatatgagtttctaatggtaggtcgctttactcgacctcccatattttctcttactgtgagtcaaacactctgaataaaaacatatctggccattccttctgaaatgcaaagcaaacaaatcaaacaggagtaaatttaccttaggcagggttttggctggtttacagtggagttcccccacaaaatcgacatttggtaagggtgggtgaagaaattcaaaatcccagtacagttgaatgagccacacttcagctttccccattgtctgaaataatgtacattaataaaataaatgtatacatatctttttatacataagcataacaattttcatatattgcatgttacttatatataaggaaagcaaagtgttcagataattaagaggaaattacatatttaatgtaacataagtatattcacaatcacaaatagttattgaaataagccactatggacttaaatatgcatttgtttcctctctaaagttgcagtagtaaccaatatagatttaaacagctctttgagctccacgattaattcatcttactatacttataaaaacagctttctacaaagcacaaaatctagtttccacaatttatcaagtcagtcccttgatccttggttctccaagtgaactgtgagttttctgagagtatggctgaaatccttgaacatactactgcttctagttcatgttaagattttaatgatattagttgtaaaatacatacatttaaaaatgatagctagtatatattcagaatttattgaaacagagatatgtgctcccccttaacttggcccatattttccctaataaagagaagtagttcaataaaatatagattaaaagcttgaatgttcactttcaacaaggtttcagttcacaaagcaaataatttccaagttgttagtgaactatgaacaaacactagaaacctcaaattttaggtttctgtttctgaaatagagccagtatacctctcaactgtgaaggaatccttctgtttatagagaaaaatattttaatacctaaataagaaaactgaggtacacaaagagaaacaagtttctcaatgctgcattaatagttatgctagaaatatgtgtagctcctcatctaaatgtctgccttcatcaagttgtttattgatatatgtattgccttttttaaagatgaaaaaagtatagtaaaatacttatatagttgcttaaagaaatcataagtgctttactttgtagttttttttttttaattcctgtagtgtcctataggagcgatggccaaagggttctagctgagcctataatatcaacatttctataatatttgtgagattgatagatcatcttacatttgccattcatcatttcatttaaacaacactatcttcttacattatatttatatacgctcaccttcaaaggcaaaaggaaagttagaacttattaaccattgattagaaacatgacttacctagaacttcactgtaaaacttctcccacttctcgtatcaaacatttgaaaccaaaagtcaaaataaagcacatgtattaaatttttaatcctctccacgaatgtcattttaccacttaattcagacagaacagcaggtatgcgggaagtggggaatagaagtcctccactatacttctcaagtgtgtagccaggagactgtcaacaaaggacatgtatttaacatgcctttaacatgctcagctagcagttcaccacaggcaccaagggcatctgcaagaacgacatcaaactttgactcttgtagttttgtcgtaattttcttgttcaaaactacatctttacagagattattaacacagtctgtagattcccaaaagagttcttgtgcttgtgagaaatatgaccaaaatgcatctttctgaagatcgtatatccatctattgatcagtttcacaacaagaccctcaaaattatttttaattagagatgttggataaacctcaaatctaatagcagatgatttactagggtgaataataatggaagccaaagatgacagcacagtcatcttatggcctctccaaacaagttcatccaggattgtctttatattcatccaatggctgtattctgtgggccacactagcacctttccacaactcccagaactaaagtgacaactgagttgtatcaggagaatatttgacatcgatttcatagttctcctggtgcaatgcaatgcttcttttcaaatcgctgtttctttctgtttttctcctacttatatctgaagataaatcaatcaagtgaaagtataactgctacaattcaaagtagtagttaccatataatttctaaattaccataggaattgtctgttaccatataatttctaaattaccataggaatttccagattgtttttcacagtggatgcttcaatttccattctcaccagcaatgtataagaattttaatttcttcccaaccttgccaacacttgggattatatttcgtttgattatagccagtgtgaatgaagtgatatctggttatgctttacctttctttgatatgaaatcatgttgagcatgttttgcctaattttggttgaattatttgtcttcttatggacttgtgtttttaatatctttctgatataagaaccttatcacatatatgatttccttgttttttttttattctttgggctgtccttttactttcttaacggtgttcattgaagcacaaaagtattgattttgatgaagtccaactaatcaattttaatttggttgcttttatttttgattttatatctcacaaaccatttccaagttacaaaaattagtacctgttatttattattagagttttatagttctagtgcttacatttaagtttttgatcacctttgaattagcttttgtaagtgatttgaggtagagggtcccaactcaattattttgtatatggataatcattattcccacttatatttgttgaataatctattctttcccccttaaatagttttgaaacttttgtcaaaaactttaaatgcatgggtgtatttctatattctaaaatccattccattgatctacatgtctatctgtaggcctgtatcacactctcttgattattgtatatttgtatttgtctttaaaagcaggaaatgtaagttttccagctcatttttattttaaattgtttcagttttttaaaaaatttttttcttcttgctttttttctttaagaggtagaggtgttactatattgcccagactagattcaaatttctgggctcaagcaatcctcccaacacagcctcttgagtagctggatttacagatgtgtttcactacacctagcttcttttggctattagtatgtctcttgaatatgtataaatttcagaatcagcttgtctgtttatgcaaagaagtgatctgggattttgatagggattgcattgatttggtatatgaatttggggagtagagtatggtaattatcacaatattaggtctttcaataaatgaagatgtgatgcctttctatttatttagatgttcttatttccacagcgttttgtagattttgttacagtggctagctagtcagacacaaacagggcagaagacggctcccacaccctaccaggaaagtcagatgaccatcagttaatggtcaggcagttgtcacactgtctcgctaaaataataattggttgcagccagccagagaaaggcagctttcctataaatagaaaaaatcaaatctggtaatcagcagcttcctgataagatctcaggagttgggtgagtgggctcacgcatgcacattaagaggccaaatggtggagtaagacattccggtggcaccagaaaagggaagaatgcctcaggggagcattcatatgactccagtaaacatactgtgcatactcatctcctaagtgctagcaggccatcacacataccagcaggtcaccctaaggaaagaatcaaggaaaatggaagcaggatcctggaagtatgccaacatataaaaccctaagtcaaaggtcaaacactgcactttaccttcaaaatggccacttggatataccccaagtgtactttcctttctttcctgctataaacctttttaataaattttcacttttgttctgaaacttgtcccggtctctttttttgccttgtgcccctcaatcaaattctttcttctgaggaggcaagaattcaggttgctgcagaaccacaaaaatttgctgcagtaaccaccactagtaataatttcacagtgagagttgtacaattttttgttaaacttattactaagaattatattttttcatggtattataagggtgattgtttaatcttcattttagtttaaatttccattgcaattttgtagattttttgttttcttatcttggatcccaaaatcttgttttattggtttacttgaatattttttagtggatttgtaaaaatttcctattacaagatcattatatatgccaatagagatagtttaacttctttctttctaatgtggattccttttatttcattttctttcttatttgttgactgaaatttctactgcaatattgagtggaagtgagaagagtcaatttagtgtgatgttagctgtgtatttttttttttttttttttttttgagacggagtctcgctctgtcgcccaggccggactgcggactgcagtggcgcaatctcggctcactgcaagctccgcttcccgggttcacgccattttcctgcctcagcctcccgagtagcagctgtgtatttttttatagatactattgatcagttttaagatgttctcctttacttctagtttaagtgttcttatgatgaagagtattgaatttcattaaataagtttttctgcagttattgaagtgattatgcagttttttcctttattctaatgatatgatatactagttggctttttcagatgttaacataactttgcattcctggaataaaattcatttgtttatggcatttaagcttttcgtatgttcctgaattttctttgctagtgcgaaaggaaagtaaaaatcttgagacattaaactcactatgtcaaagagaaaagttaatcttgggaaacaaaccatgtaaaactggctcccattttgttcctaaacagataaatgcaaaaatagaaggccacatacctctccagagggcctccttcccaatttactcacaaggaaaatcacaaggtcctaaaacagagttctcttgacttttaccctgagagtataaattaacattttatatttgcaggtatataaaagacaggacttgaagccattgtgtggtttttagcataagggcttactgaatggtggttatgttttctcctcttttattttttggaggattaattattttaaatatttgatagaagtatagagctttgatattttctactctaccatttccagttattaccccactatttttttctaaataatatttcactggaagccatcagacactggcttttcttttatgggagactttttccttacagcttcaatcttgttacttgttattagtttgttcaggttttttatttcttcatgggtctatcttggttggttgtatgtgtccaggaatttattaatatcatctaggttttccaatttgttggtatatagttgttcataatattctgtaataatttgtgtttctgtaatctcagttttttgtctcctctttcacttctgattttatttagtgggtctgttctcactttttccaacttagtctagctaacagtttgttgattttgtttacttttacagagtttaccttattgtctgtggctgcttttgtactacagtggaagagttgagtaggaacaagagtctaaagggtttgcaaattccaaaaatatttaccatctgaggctttatagaacctattctgatctctgcaggttcattttttcctttaacctttctatatattcaatatatatttctatatatttctgtattactatatattcaatatattgtatatattcaatgcaattttaataaaatagtatagatttttagtgagtcagatgatttatgtttaattatgttaataatgagttaataaattaatttgtatttccattttatttagaataggtgagtttgtttgttatgtggaatggtgcttctgttttaccttttttttgagaaatctctaaactgctttccacagtaattcaactaatttgcaatccaccaacagtatataagcatttccttttctctggatcctcactagcatgtggtattattattaatttatactttttagtaatagccattatgactagtgtgagatggtctcattgtggttttgatttgcatttctatgatgattagtgatgttgagcatttttgtcacgtttgttggttccttgtatgtcttcttttgagaagtacctgttcacatcttttgcccggtttttcacggggttacttgatttttgcttgttgaattattcaagtttcttatagattctagatattagacctttaacagatgtgtagtttgctaatatttcttcagtttacatctcacttgtgaattttgagttttgttgcaattgttattaaggacttagttataaattctttcccaaggctgatgtctagaatggtatttcctagattttcttcaataagtcttatagctttaggtcttatatttaaacatttaattcatcttgggttaatttttgcttggtgaaaagtagagatccagtttcattctttttcttatggctagcaagctatcccaccatcatttattgaatagggagtccttttctccattgcttatttttgttgactcagtgatagatgactataggtctgttgctgtatttctgggctctgtattctgtttcattgatttatgtgtctgtttttgtaacagaaccatgctgttttggtgtctgcagccttataacatagtttgaagttgggtaatgtgatgcctctggctttgttctctttgctgaggcattcttcagctatttgggctaatttttggttttatggaaatttttgaatatttttttctaattctgtgaataatgacattggcattttaataggaatagcatttaatgtgtggatggctttggttaggatggttattttaatgatattgattcttccaaccctgagcataaaatgctctaccatttgtttgagtcatctatgatttatttcagcagtgctttgtagttcttgtagaaaacttttgtctccttggttagatgtatttttaagtatattttgtttgtgtgtgtggtataaatgtgattgtgttcttgatttgactcttagcctgaatttttattggtgtatagaaatggtattgatttttgtacatggattttgtatcttgaaacattactgaagtcatttttcagttctagcaggctttaggcagtctttaggattttctaggtatagaatcatatcatcaccaaagaacaataccttcaattcttttcctatttggatgccttttatagctttctcttgcttaggtgctcaattaatacattattgaaatagaaagtgctgtcattttaatcatttatatttgaaatataaaattttaaaaatttatatttgaaattttaatcatttatatttgaaacataaaattttaaaattttaaaattttaaaagatttggactatgttaagtccaaattcattgcagaaatgtacttatccatttaataataataatagttatagcaaattgaattttgctatatacagcaattacatacagcaactcttttagtctcagcaatgctattaagtaggtagtgacattgcttcatctacatttcactgaaggagaatgtgaggcatagacctgataagtaatttgcttaaccataagtgattctgtaatggttttgcaaagatgatataggttatctggattcagagtgcaagctcttacccaccatcctatgctgactactctttctgggttacaggtagttacaaaatgtaatatagattcactttttttgtaggtatatattaattttaatattattacaggagtataactcaaatatgtaaaaatatttttctggttgtctatcactgcttaaccaactgctctgaaatgaaggtgcttagaacagcaacattttatcatcatctgttttaattctaggttgttggccaggctcagttaggtgtttatggcacagcatttctcagttggttactgtcctaaggtagcttgggctaatcatctgaaggttaatcactcacatatctggtgattagtattaaaagtctcaagctactgcagtgctgggccaattgtgacttattaggcatacatatgtatttctacaccaaatggtatatttctcctggggactgtggatatagcacagggctccaaagcgagtggagagacagagaaaaaggaaaaaagaatgacagaaacacagagaaaaggacagaaggacagacagagaaaatgtattaacaatttttttgagctttggaagttaagctcctcacttccactatattctcttttttgagacagccacaaaatttgctaaatttcacaggaagggtatatgacttgatgagaggattgccaatgcatttgtaatcacatctcaaaattactgcgaatataaccttaaaaattagaagaaatcactaaactactgtagaattcataaaatgttgacataagacattaaaattttaaaaatttgtttgctaaaattttagccataattaaaaattttaattaacattctaatatatttattaataaatatttaaaatatcaagtaggtgtccaaaaacaggctgtaaatttatcagatagagagcaccggattgctggtcaatttaagttttctaaatggcactaatggattgataatattatattaaaacccaagaacatgctatctcaaatcaatgtttatttcactaattaatttttaaaactatataattaatatataaaaacaaatttgtgaaaggttagtgaatgaagtatatagaatcaaaattaaaagtagaatcctctatgtttatacagatttacagattcttaattttatttcaaagaagaatatcatacttttttttctgaaactttttttcatttagcaatgtgatgtggagagcattccatgatattgtctgtaatatgcctgttctctgtaattgctgcataccttctactttttgtggtaggtatgtatgttcattgactgatagccaggcaagtgatggagggaacatcctgtacatacatgcactcaggtgcaagtatatctggatggcagatgactagatgtagaattgcagagtcaaactgtatgtttaattttttttgtaagagttgtttcactttatactctctcacaaactcttttctcagattcttatgtttgatcaatctcctgtgggaaaataattcgttgactttttatggctacatagtaatccatggtgtatacatactgcactttccttattcagtctaccattgatggacatttaggttgatttcatgtctttgctattgtgaatagtgttgcaatcaacatatacatgcatgtgtctttataatagaatgattatattcctttgggtatatacccagcaatggcattgctgggtcaaatggtatttctgtcattaggtcttggaacagacaaccaaatgctgcatgttctcacttacaagtggaagctaaatgatgagaacacatggccacacaggaagctaagtgatgagagcacatggaacacatgaacaacacacactggggcctcttggagggtagaaggtgggaggggggagaggatcaggaaaaataattagtgggtactaggcttaatacctgggtgttgacacatatttacctatgtaacaaacttgcacatgtacccctgagcttaaaataaaagttaaaataaattcattgacttaaggttattgacttactaaattataatgtccaactttctagtacaagtagccatctttttgatgtgattggccatttttacttctgtgaattgtcaattcatatccttcatctattttcatattggtctgtttgtctttttggttggtgatatataatagctctcactatacaagagataccagtcctttatctatgtgttgcaggataagcttgatgtaaattactttaggtttgtatgcatgatttagcaatattatctactatgacactatattcattcaatttttcttaaaaatgtttcatttatctagatacattttataaaaatgttgctgcaatctcttccaataattcccttagcatcaaaattttaatttatttttagaatacattcatgccataggtcatagagtggttattgtgagacttggatgatggtcttcttaccaataaagacacataggtttgtgttaacccatactactttgatcataaagtgtttccttgatgtgtagcttttaagagggccttgagaattcctgagattttattatttgccaatttttggtaatttttgtggtcttttaattgttactgattatgattagttgcaatatgcttacattttaaaaaatcattatcctatttttggtcatgctaaatgacttatgttttcatattagtgttatgggatgaatagagttacaggcttctgaggaaagagagaaacatgagacatccttatataaaatagggttatatagaataattatcatttttaactgtcttctacaaacacattcagtttcacaaacatctgtaaggcagctcaataattctgtgccttgttttggaagaagtgaacacatatatacatgtacatttgtgataatcaaaatcagtaagtccccttaaagtgctggttttatattatcacaacctacaattcagacattttatccaatattaaagtttaaaaatgaccgtgaaagcaaccagttcacactttagaaaagttcatggggaaaagagaattagcttgtgaacaaaggttttcccaaatagttaaattttgtagtatttgtcaggtaggagtcattctatctctaatttgttgttctccaactccaagtctctgagtcccattattttgctcttcaggccctgaatttggcataaagtgtagtagaggcggacagtgtcgtctcctgtgcatcactgttgttttgcgaagaaattctcaatgtggtcagctgctgctgctacagaagtcgattttctttaaacactgccaagaacatctgacttacatagtatattttgatttgatatttattcaaactgagcctgctttttttctttttacaaactctctaaaactgctaaaagtcttcactttataaactatgtaattaccatgatctttatactgttggtaaagcaatggttcactttccccatgtctttcacctcagttcttttctcccctgtgtgaattgtatccattttgttcaaagtgattttactgaataccaggagttatcacctctcaagtgttattggcaatgagattgtttttgccagttatcagtgaattattaaattccaaagtcccttgttgagggtctgctttttagtgccacttgcccaagctgccatagtctatttttctcagaaagcaaagcctgagataagaattagtgtgcaataacttaatttgagaaatgttcttagggtacaggagtaggggacaggaaagggtgaaacaagaagggagaaaagtcagtacaagaatgtgttaccaaactaatcatcaccataactgttgggactaaagctcatgcggacccagtaggaagttgtgtggatgtaaagcgtgatcattaaccatcactttctattgctcacactgccaggttatgcatatgtgagtgagtgctagctgagtttcttcgagggttccatgaagagatgttaaagaagtctggtgcagaaaatgagagacctgtcctatcagaagacgacttcacaaagctccttgacacagcaaaggctagagaaaaaaaaattagctgaaaaaatatggggtgcaacctaatttgatcaaatgtattagagctttcttttttcttttgtttcattttcacagtatattacttttcatatgattaaatactgtaaattttctcaggtttctgataaagttatgcctgtgatacaggagctagaaagaaattatttaggcagatagtgagggtgaaagtccttggtaaggttttgttttaataaaaagcagccccccaaatcatttccttgctaacaaaaagcagccagaaaaatcaagcttcaaacctagataaacaagctaaagcttgcataggtaaatgctggcaactgtgccagtaattcctcaaggatctagaactagaaataccatttgacccagcaatcccattacttggtacacgcccaaaggattctaaatcattctattataaagacacatgcacacgtatgtttattgcagcactattcgcagtagcaaagacttggaaccaacccaaatatccatcaatgttagactggataaagaaaatgtggcacatatacaccatggaatactacacagccataaaaaaggtaagttcatgtcctttgcagggacatggatgaagctggaaaccatcattttcagcaaactaacacaagaacagaacaccaaacaccacttgttctcactcataagtgggagttgaacagtgagatcacatggacacagggaggggaacatcacacactggggcctgttgaggtgtggtggactaggggagggataggattaggagaaatatctaatggaggtgacgggttgatgggtgcagcaaaccactgtttcacatgtatacccatgtaacaaaactgcagattctgcacatgtaccccagaacttaaagtataattaaaaaaaaaaaagaaagaaaagggatgggataccttgaagccaggtatattcaacatggatattcaacgtggaggtcccctctttccttttctttgtcaaccatatgtgcagtaaagaagcagcaacatggcactggccatgtagagaaaccatttgcttattgaaaattaaggtggggcagacagcttcttcttacactatgtaaatggcacacctggttccaccaatcctttgtgccctatataaatcagacactgtttcctcaagctcatctataaatccctgtgcatttcaccatgggactagaagatccattcgggagcacctttctgcagaaatgagagctattctcctttctctttctttcccctattaaacctccattcttaaactcacttctcgtgtgtccatgttttcagtttccctggagtgagatgatgagttttgagtatttaccccagacaatgatgctgcttaacctgttacttttatttattcttatttttaaaatttttatttattttttatttattttactttaagttctgtgatacatttacagaacgtgcaggtttgtggcataggtattcatgtgccattgtgatttgctgcacccatcgacctatcatctaggttttaagccctgcatgcattaggtatttgtcctaatgctttctgtccccttgtcccagaccccctgacaggccctgatatgtgattttcccctctctgtgtctatgtgttctcattgttcaactcccactaatgagcgagaacatgtagtgtttggttttctgttcctatgttagtttgctgagaatgatggtttctatccatatccctgcaaaggacatgaactcattttttatggctgcatagtattccatggtgtataggtacacattttatttattcggcctatcattggtaggcatttgggttgtttccaagtctttgctattgtaaatagggctgcaataaacatacatgtgcatgtgtctttatattacaatgatttttaatcctttgggtatatatccagtaatgggattgctgggtcaaatggtatttctgcttctagatccttgagcaattgccaaaatgtcttccacaatggttgaactaatttgcactgccatcaacagtgtaaaagtgttcctatttctccaaatcctctccagcatctgttgtttcttgactttttaatgattgtcattctaattggcatgagaaggtatctcattgtggatttaatttgtatttctctaatgaccagtgatgatgagctttttttcatatgtttgttggccacgtaaatgtattcttttgagaagagtctgtttatagcctttgcccactttttgatggtgttgtttttgtcttatatatttaagttccttgtagattctagatattagacctttgtcagagggatagattgcaaaaaattcctccattctgtaggttgcctgttccctctgatgatagtttattttgctgtgcagaagctctttagtttaattagatctcatttgtcaattttggcttttgctgcaattgcttttggtgttttagtcctgaagtcttcgcctatccctatgtcttggtattgcctaggttttcttctagggttcttatggttttgggttttacatgtaagtctttaatccatcttgagttaatttttgtataaggtgtaagaaaggggatcagtttctgttttctgcatatagctagcaagttttcccagttttcccgttgcttgtttttgtcagttttgtcaaagatcagattgttgtagatgtgtggtgttatttctgaagcctctgttctgttccattggtctatatatctgtcttggtaccagtaccatgctgtttttgttactgtagctttgtagtacagtttgaagtcaggtagagtgatgcctccagccgcttttttttgttttgttttgttttgttttgcttggggttgccttggctatacaagctcttttttccttccatataaaatgtaaagtagtttttctagttgtgagaagaaagtcaatggtagcttgatttgaatagcattgaatctataaattacgttaagcaccgtggccattttcatgatattgattcttcctagctgtgagtatggaatattttttcatttgtttgtgtcctctcttatttccttgggcagtggtttatagttctccttgaagaaatccttcacgtctctttttagccatattcctaggtactttattctctttgtagtgcttgtgaatggaagttcaatcatgatttggctctcagtttgtctattatcagtgtataggaatacttgtgatttttgcccattgattttgtatttggagactttgctgaagttgcttatcagcttatgaaatttttgggctgagatgatggggttttccaaatatagaatcatgtcatttgcaaacagagacaacttgacgtcctctctttctatttccataccctttatttctttctcttgctgattgccctggctagaacttccaatacaatgttgaaaaggagtagtgagagagggcatccttgtcttgtgccggttttgaaagggaatgcttccagcttttttgcattcagtatgatatgggctatggatttgtcataaattgctcttattattttgagatatgttccatcaatacctagtgaatggggagtttttagcatgaaggtgtgttgaatttatcgaaggccttttctgcatctattgagataatcatgtggtatttgtgattggttctttttatgtgatggattatgttcattgagttctgtatgttgagccaggcttgcatcacggggatgaagctgacttgattgtggtggataagatttttgatgtgttgttagattcggtttgccagtattttattgaagatttttggatcaatgtccatcagggatattggcctgaaattttcttttttgttgtgtctctgccaggctttggtatcagcatgatgctggcctcataaaatgagttagggagaattccctctttttctgttgtttggaatagtttcagaaggaatggtaccagctcctctttgtacctctggtagaattcagctgtgaatccatctggtcctggactttttttggttggtaagctattgattattgccacaatttcagatcctgttattggtctattaagagattcaacttcttcctggtttaatcttgggagagtgtatgtgttgaggaattcatccatttcatctagattttctagattatttacatagacatgtttatagtattctctgatggtagtttgtatttctgtgggattggtggtgatatcctctttctcattttttatttcatctatttgattcttctctcttttcttctttattagtcttgttagccgtcgatcaattttgttgatcttttcaaaaaaacagctcctggattcattaattttttgaagggctttttgtgtctctatttcgttcagttctgctctgatcgtagttatttcttgccttctgttagcttttgaatgtgtttgctcttgcttttctagttcttttagttgttgtgttagggtgtcaattttagatctttcctgctttctcttgtgggcatttagtgctataaatttccctctacacactgctttgaatgtgtcccagagattcttgtatgttgtgtctttgttctcattggtttcaaagaacatcttgatttctgccttcatttcattatttacccagtagtcattcaggagcaggttgtttagtttacatgtagttgagtggttttgagtgagtttcttaatcctgagttctagtttgattgcactgtggtctgagagactgtttattataatttctgttcttttacatttgctgaggagagctttacttccaagtatgtggtcaattttgtaataggtgtggtgtggtgctgaaaagaatgtatattctgttgatttggggtggagagttctgtagatgtctattacgtccgcttggtgcagagctgagttcaattcctggatatccttgttaactttctgtctcgttgatctgtctaatgttgacagtggtgtgttaacgtctcccattattattgtgtgggagtctaagtctctttgtaggtctctaaggacttgctttgtgaatctgggtgctcttgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggcagatcttcctccatccttttattttgagcctatgtgtgtctctgcatgtgagatgggttttctgaatacagaacactgatgggtcttgactctttatccaatttgccagtctgtgtcttttaattggagtatttagtccatttacatttaaagttaatattgttatgtgtgaatttgatcctgtcattatgatattagctggttactttgctcattatttgatgcagtttcttcctagtcttgatgggctttacattttggcatgattttggagtggctggtaccggttgttcctttccatgtttagtgcttccttcaggagctcttttagggcaggcctggtgatgacaaaatctctgagcatttgcttgtctgtaaaggattttttttctccttcacttatgaagcttagtttggctggatatgaaattctgggttgaaaattcttttctttaagaatgttgaatattggcccccactctcttctggcttgtagagtttctgctgagagagctgctgttagtctgatgggcttctctttgtgggtaacccgacctttctctctggctgcccttaacatcttttccttcatttcaactttggtgaatctgataattatgtgtcttggaggtgctcttctcgaggagtatctttgtggcattcgctgtatttcctgaatctgaatgttggcctgccttgctaggttggggaagttctcctggataatatcctgcagagtgttttccaacttggttccattctccctgtcactttcaggtacactaatcagacgtagatttggtcttttcacatagtcccatatttcttggaggctttgttcatttccttttatacttttttctctaaacttcccttctcacttcgtttcattcatttgaccttccatcactgataccctttcttccagttgatcacatcggctcctgaggcttctgcattcttcacgtagttctcgagccttggctttcagctccatcagctcctttaagcacttctctgtattggttattctagttacacattcgtctaaatttttttcaaagttttcaacttctttgcctttggtttgaatttcctcttgtagcttggagtagtttgatcgtctgaagccttcttctctcaactcatcaaagtcattctccgtccagctttgttccattgctggtgaggaactgtgttcctttggaggagaagaggtgctctgctttttagagtttccagtttttctgctctgttttccccccatctttgtggttttaactacttttggtctttgatgatggtgatgtacagatgggtttttggtgtggatgtcctttctgtttgttagttttccttctaacagacaggactctctgctgcaggtctgttggaatttgctagaggtccactccagaccctgtttgcctgggtatcagcagtggtggctgcagaacagcagattttcgtgaaccgcgaatgctgctgtctgatcattcctctggaagttttgtctcagaggagttcccggccgtgtgaggtgtcagttctcccctactggggggtgcctcccagttaggctgctcaggggtcaggggtcagggacccacttgaggaggcagtctgcccattctcagatctccagctgcgtgctgggagaaccacttctctcttcaaagctgtcagacagggacatttaagtctgcagaggttactgctgtctctttgtttgtctgtgtcctgcccccagaggtggggccttcagaggcaggtaggccttcttgagctctggtgggctccacccagttcgagcttcctggctgctttgtttacctaagcaagcctgggcaatggcaagtgcccctcccccagccttgttgccatcttgcagtttgatctcagagtgctgtgctagcaatcagtgagactctgtgggtgtaggaccctccaagccacgtgcgggatataatctcctggtgcaccgttttttaagcccattggaaaagtgcagtattcaggtgggagtgacccaattttccaggtgccatctgtcacccctttctttgactaggaaagggaactccctgaccccttgcacttcctcagtgaggcaatgccttgccctgcttcagcttacacacagtgtgctgcacccactgtcctgtgcccactgtctgtcactccttagtgagatgaacccggtacctcagatggaaatgcagaaatcacccgtcttctgtgtcactcacgctgggagctgtagactggagctgttcctatttggtcatcttggctcctcctcctaattcttgaagatttcattggctaaagtaaaacaaaaattctgctcaaaatgaagccaaaatattttgagtatttgcaaaacaatgttgatactatgagtggagttcttaatgttgttgtgttcaaatacaatgtgtgaaacataatgaagctcagtaactttcgtgtgtaacttttggattagaataataaatatcaatataagcccataaggttttatattatttttatttttcttttcttttttttttatggcttggatgacactttattttcagatccaatactagaagttgtttccatgttcacattttccttcctggtttaaaaaaaagagttgtattttttttttttgctttttttaaattatactttaagttttagggtacatgtgcacaacgtgcaggttagctacatatgtatacatgtgccatgttggcgtgctgcatccagtaactcgtcatttaacattaggtatatctccaaatgctatccttccccccattgtatttttcatagcttaaaaatcattgacatagaataattcagctaaagtacgtattaaatccctggaaaataaattttgtcttaacaaggtaagttgtgaaaagatgttttgtcacaggaaaaaggaaatcctccatttaaaaccctccatgctgaaataaaggaggagtcccatctttcagtcattccacttcaggcttttgatataactaatctcttttcttcttctttccttttttggcaagctttcggaaacaaaacaggcaaaattttgtgatgataaatatcacagttgccacgcaggccagcaggaatgctatcacatccaaagagtggtactggatccaggtgaggttgtgagctgcgactcgaaggtgcttggctcctttgtggcgcatgacaaactcaatccagaagactgctcgatccaggggcttcattggttggtcatgatgaattcttgataatttcatgacattctctttatagctgaaggataaatataaagatatcaacattaaaagtaaatttattgcttaagcatatcaagtctatggatggtctttgaaaagtgtcacacaaatgattgaaagtaagtgtcactgaattggcatgaaatttcaatgttttaattcatgtcattacagaaagtttggtttttaaattggagttttatcactgacaaatacctttaaaaatgaaaaatggaattttcggtgggaaagttaatgttttctggagcagaaaatattatgagccattctaagtgctataagtaagatagtggaaatggaatttgagaatgatctttttgatctttttaatttttttttattttttgagacaggcttttgctccattacacaggctgagtgcagtcacatgatcatggctcagttcagcctttctctttcggtctcaagtaatcctacatctcagtctcatgagaagctaggactacaactgcacaccaccatgcctggctatatttttttattttttacacttttagatatgaggtgttgctgtagtgcccatactggtctggaactcctgtagtcaagtcattctcctgcctctgcctcccaaagtgttggccctacagacatgaaccactgtgcccagcccattttgacgtatttaaagaagaattgtgacacaactggtgaaatgcctcctaactagtttctcagcttctactctaatcttttgtcttctaccatattttccttctagtagccagaatattttccaaattaatatcaaattatgacactcacctgttaagatttccatctggtttcttgttacattaagaataaattccaaatctgtctttggtctagagaactctacacaggcacctacttgtcctagccctttccccctgtacactttcttctagagacaatggccttcggtttttctctaaactcctgaaggtgttctcaccttagcccctttacaccttttgttccccgtgtctctctcattgagcattctttcttgcaactacttgaggtttgcttctatttctttttgaggcttccccttgtatgatacctcttggagagtcttttcctggccacactataggcacccataggatttctctagtgcttcatgcttactttgctatttgatttctggaactttaaaatatgttgtatatcttctacagtaaaacttcaagtatgaaatacataggataaatgtatatatactatgtgactacctcaaaattttaagattatcttaaacattatcccaaagtgaagacaccaatttatcacaaactgcatagaagaactctctcctcctgggccattttagtcactatttttatcctcaaagtaagtattaacctgatttctgatatcatagattagtattgtttatataattgaattaaataatacatattcatttctgtttttggttagcagttgtttaatagcattggtgtagagagtattcagttgattgacaaagaccacagatgatctcttcattttgtgattaatggatatttgtgttgttaacattttttgaccttactaataattatggtattaagatatttgtatattttattaggtttaaatatttattcatttttgttggatgtatacttggaagaatagttgatgagagaaaggcacatttataattagaattttttgttgactgaattttttaaaaaatattttttattttaaagaatcagattgttttcagttatcgtttttggatgatttataatttatttctagtatgactagaacatataatttttatgaatttgaatctgatacaatttacttagtgtttatttatggcccagcatatggtaaattcaggtaactatttcatataatctttttttttttttttttttttttttgagacagagtctctctgtcacccaggcttgagtgcaatggagtgatcttggctgactgcaatttgcatctcctgggttcaagtgattctcatgcctcaatctcccaagtatctgggactacaggtgctcatcccctacatctggctaagttttgtattattagtggacacaggatttcaccatgttggccaggctggtctcttaactcctgacctcatgtgatcctcccactttggcttcccaaagtgtcgggattacaggtgtgagccaccacacccggtctccataaactcttttaaaaatgtttattttctgtctacacacacacaaccagagatatatgtatggatacatatatacagataaatgtgcaatatatatacacacacacatatataacacatagattacatttaattgtgtacttcaaatgttttatctccttaaataaaatatttcaaagatcactattttgtcttttctttttggtctgcttaaatttaatgtgagtactggtaggttcacttttttgtttttttgcttttttgtttttttttgagatggagtctcgctctgtcaccaggagttcagtggcactatctcggctcactgcaacctccgtctcccgggttcaagtgattctcctgcctcaacctcctgagtagctgggactataggtgcacaccaccatgcccagataatttttgtatttttagtagagacagggtttcactatgttggccaggagtatggtctcgatatcttgacctcgtgatctgccctcctcagcctcccaaagtgctgggattacgggcgtgagtcactgcacctggtcagttcaaatttttttaaaaagttttatttttactttaagttccagtatacatgtgcagaatgtgcaggtttgttacatacgtatatacgtgccatggtggtttgcagcaccgatcaacctgtcatctagattttaagcccctcatgtattagctatttgtcctgatactctcactccccttccatcccccggtgtgtgttgttcccctccctgagtccatgtattctcattgttcaactccctcttataagtgagaacatgtggtgtttggttttctgttcctgtgttagttgctgcggataatggctttgcatttcatccgtgtccctgcaacagacatgatctcattcctttttatggtgcatagtattccatagtgtacatgtatcatattttctttatccagtctatcactgatgagcatttgggttggttccatatctttgatattgtagatagcgctgcaatagacatacatgtgcatgtgtctttatagtagaatgatttatatgcctttgggtatatacgaagtaatgagattgctaggtcaaatggtgtttctggttctaggtctttgaggaatcaccacactgttttccatgatggttgaactaacttacattcccgtcaaaaatgtaaaaagctttcctatttctccccagcttcaccaggatctgttgttttttgactttttaatcatcgccattctgactggcatgagattgtatctcattgtggttttgatttgcatttctctaatgatcagtgatattgagcttttttcataagtgtgttggctgcataaatgtctttttttaagaagtgtctgtttatatcttttgcccactttttgatggtgttgtttttttttttttttttgtaaatttgtttaactttcttgtagattccggatattagacctttgtcagagggatagattgcaaaaatcttccctcattctgtaggttgcctgttccctctgacgatagtttattttgctgtgcagaagctctttagtttgatttgaccccatttgtcaattttggcttttgttgcaattgcttttggtgtttgtgtcatgaaatttttgcccatgcctatgtcctgaatgatattgcctaggttttctcctagagtttttatggttttgggttttacatttaagtctttaatccatcttgagttaatttttgtataaggtgtaaggcaggggactagtttccgttttctgcgtatggctagccggtttctccagcaccatttatttaatagggaatcctttccccattgcttgtttttgtatggtttgtcaaagatcagatggttgtagatgtgtggtgtttttctgaggcctctgttctgttccactggtctatatgtctgtctttgttccagtactatgctggtttggttactgtaaggtgtaaggaagggatccagtggcagttttctccatatggctagccagtttttccaaaacatttcttaaataaggaatcctttccccagttgcttgtttttgtcaggtttgttaacaatcagagggttgtagatgtgtagtgttatttctgaggcctatgttctgttccattggtctatatatctgtttggtaccagtaccattctgttttggttatgtagccttgtagtacagtttgaagtcaggtagcatgatgcctccagctttgttctttttgcttaggattgccttggttatatgggctcttttttgtttccatatgaaatttaaagtagtttttttctaattctgtgaggaatgtcaatggtagtttgatgggaatagctttgaatatataaaatactttgggcagcatggccatttttacaatattgattctttttatccatgaggatggaatgtttttccatttgtttgtgtcctgtcttaattccttcagcagtggtttctagtcctccctgaagaggtccttcacatcccttgttaggcatatgcctaggtattttattctctttgttgcaattgtgaatgggaatttattcatgatttggctctctgtcaaatcatgtactgtcagtgtatagtaatgcttgtgatttttgcatattgatttttgtatccagaggctttgctgaagttgcttatcagcttaaggaattttggagctgcgacaaaggggttttctaactatagaattatgtcatctgcaaacagagacaatttaacttcttcccttcctatttgaataccctttatttctttctctagttcacatttaaatccagcatcttattctatatatatatatattttaattttctaacctgttttatgtttctttactttcttactttttttgaagtatcttaaatcatttcttgtcttactaattttttggtaaagtgtttttaatgtattcccttagctggtaccacctaacctcataataatattggtaggagtaatagactctgaattgatggtagctggtctaggcacagcatttttcatagtatttcctttggattatggaaaagttaagtattacatatttattttatcaacattgaaacctttgtatttcaaaaggcatcttccaaaaagtaaaaaaaaaaatctatctgtccatagtggaagaaaatatttgaaaatcacatatttgataagggattgtatctataatatataaataattcttatgaatccataagataaatagaaaaagacaaaatattcacaagattaaaatagaaatttatctaaggaagatgtgtgaatgaccagtaagcacatgaaaagagggttaacatcttcagccataaggaaatgcaaatgaaaaccataatgagagaccactttacacacactagaatggctgtaatagaaagacaggtgataacaagtgttgggaagagtgtgaagaaattagagccctcctatccagctggtggtaatgaaaaatgatgcaaatactttgaaaaacagtttagcagttcttcataaacaacaatttcccatatgtctcagcaagtccactcctagcatctcctcaaaagaagtaaaaacatatttttacacggaaaatatgtataacaatgttcataaatgccaaaattggaaagacctaaaatgtccatgacctgataaatgggtaattttggtataaacatatcaaagaatattatatagaaataaaaatgaatgagttctgatacatcctacaacataaataaaactaaaactaattatgctaagtgaaagaagtcatttatgaaacaccataaattgtatgatttcatttatataaaatatgtgaagagaataatctattgagaaacaaagtaagatggtatttttctaggactagaggtttattgggagtgacttcatacattatgagtttaatttgaattcattaaaatgttctttagggctgtggctttgtaactatgtaaacatactaaatatatttagattttaaattttagtgaatgttatgctatgcaaattataattcattatcacatttcttaaaataatgataataaaaataaatttttgagaaagaatagattcatactttcagaaattttaggtattgaattgaaatatcatatttctctagttatgttctttcttttcattgtgcattctatcattaaaaatatttaaaataattatctacatatctttaatttttttgattttataattcattgcagtcattggtgacccattaaatctgtggggttgaaatgtaactttgaaataaactgtctggtggaaagtaaggacagattttacattggttaaatcacttcaatcccttcaaaattagtctcttaaaaacgggttaaaattcatattcactgttgacaaaataatttataaataccacctggtcacaaaactgtaatactcacacagggtcattaatgactgacttcaatgcattgagcaaatctctacttgacatggtcctgatgtccacactgagggctgctcccttggctttcatgtgagcaatgttatcatgttgatccgcaaacaagggaatgcccaccatagggatcccatggtagatcgcctcatagatgccattggttccaccatgagttataaaagctttggttttgggatgacctaaaagtggatgcattttaacaaaattattaattacaaggtatgagaattgaataagaaatgcacaatataaggaacttaaagcaaaactgttccctaggtaacattatacccacaaaactgcattgaaattgttttcaaatttcagaagaattgccaggtgaacaaaatgaaaaagcatattcttaattaaaaaattaaaatgtgcaaaaaaaagaataagattgggtatacaagaacgtggtcttttaagtattataaataatgaggtcacatttacatatttaaaaaatatttaaatacttaaaatatttaaaatatttaattttttttaaaaggcagcagggagtagggtggaggtggggctgaggaaggaccggttatgcatcatcatgaaatgtgttatcattttatcatgataaagattggttatttattcccataaaaagtagagtcactggtaatagaaaagtgtccgctatttttcagtgcctgttgaaataaccctgcagtaggggaaagaacagaggtaaagctgcataaataggagacagacagaaaatccaggatgttatttaaaacctgtgagaggaaattacacctgaacaaagagatttttattctgaccataaagaatgtgactgtatgtaataaaatgccaactactatagtgcattctttttatactaagactggaaaataaatataaagtagttaaatttgatttgttttttagttttccaataataaatgctaaatatgtttgttttatgttgaactattatcactccaatttgctgttactaatatattcactgtttgttctccagaatcttaccaagaaggtcattctggggtaaccacttgtacagtcgagtattggaacctaaagtatttggcttcttgccatcaaatctccatagaacctgttagggcaaggaaaatatcttgttcaatgaatagaactctaaaaacatagcatgttagaattctgaagagattaataatcagttagttaatccatataaaagatgaagaaataagaagaagtgatgtcaagtaatgagaactactaaaagtttgaggtaagttgaatacccacgtttaatgtcgttacttttataatcaattttgtatataaagaaataatgacatttctaacataatagctagacacatgagattgtgaaaggaaaataaatcttggcaacccaaactctatgctaaagggaaaagttaagctgcttagggcaaacctacctcccattctattcaaagtcagcccttgactcactgagataaatgaatatcaaattgcctcatttcgagaggctaatcagaaactcaaaggaattcagctatttgtctctcatctacctatgacctggaagccccttccatgcttcaagttgctctgcctttgtttctagctgtctcccatttctggaccgaacaaatgttcatcttatatatgttgattgatgtctcatgtatccctaaaatgtataaaaccaaactgtccccccaccaccttggacacatgtcatcaggacctcctgaggctgtgtcatgggtgcacattttcaaccttggcaaaataaactttctaaattatctgagaactgtctcatatattcagggttcatattttggtaaccatgaagagattctgagtggaggttccctgacctttgataaatgtcctatcagtgcttggtaccagcatgagctaaatttatggctcaaacaaagaagacaattggctgaggtctgggagcaacccctccagagaatctctgataccccaaaattcagacaagatctgaagtttattttgctgtacaactcctttttgttttttttggagttttacttgcttcctacaagaaaggcaagatttcctgtttccatgacaatggaaggcaggtaactctatggagtttgagctcgctcccaggagggaggatgaatttgaggtttctttcctgattctaggatggcagagggcagttttggcctgaaacccatccgtaggtaaacagctgaattgcggttttgtcttggttaatgtttaacaactagctggacttaatttctccttaccattacagtgcttagtgatcacatttctgggatttttttttttttttgtacattccagtatttctcccatcagatttgatgaactttacctgacttgatcaaatctgagtgagaattccaaattgtgggtaacaaagcctgtctaatttggctaaaattctttgcagacgcaaaagagaaaacaaaacaaaacaaaacaaaacctaaaaaccatgctcttggtttctgtgtttgcttcctgtctttaaaaaaacaaatgttcttttgtttacttttcctccaccctatacctccttttgccttttgccatttgcagtatgaaaaatctagagaaggcttctaatgacttgaactcttttaaagaattcagaacaaaggcaccactcacccctttaggggtgtctgttttctttgtggagttccaagagttgtgggcagatttttttctcagtccaaagctctgttttcctatgttgaatgacctgatctctttggctttgagattaccacagattaccttgtactgtgagaggattttaccttggcatgtgtaatggcagacgagttacaaagtagggggtggctgagtacagtttactggaagtagtattgactgttgctatttttttcctcctaggaagttgttgtttaagaatcctaattctagtttggagatgtgttgtaaagggtctcctctattgtttttattccccaaattaatctcatttggcttgtctgtgtggatttgtgtgagaaactgaactgtggtttacataggaaaatgagagactgagttttctcagctccaaagtgaaagggcatctgctcctcccaggcaaaaggcacccctaagcaactgggggccttgtgggagtgtcttggggttgaccccctgtgacatggagtggccctgcagggaaatccccaataaaaattaacttttaaaaaaaggctagtccaggaaacacatatgagggcagatcacccagcattttgagccctctcagaggtcatacacctctggagagagaaactgagacatgtaagagggtggaaacaactcagtggtgacacactgtggagtactgcccacaagcagcacacattgattcaccacacataaaccctaggccacagctcagttcctccttttaggaaaaaaagtgggaaacaaataatctaagaatgatgagaaaacaagaagaatgaccccctgatatcacttggtaggttttatgacacctctacttggcagagtttatgtaaaatgaaggtaatacggtctttgtgcacatatacattaagaaccctaggttgtcctgcaagctatagagttcctaagttctctctttttaaaaaaaattcttttcttcttgctttaaatttgcttttatttttctattaagataaaaaccacactatggattcaacaggtttttgtctgcaagctggtcaattttttttatctcatggctaaagttctgaagtaaaagccatagaatcttttgtgtgtgtgtacatgtgtttgcatatatttaaaaggccattataatttctataattttatgtttaataggcaattgaatccattttattttccttccagcacaccaaattttttgtctctgtaccttatgatgtaaattttgctatttaattttcacttggtttcttttaatatgcaaatgtaagactatttagcttacaactgcctatggtgatcaagtattcatacagattacctattgaaacaggttatcaagaatttggaagtctaatatggcaaaatgtagttttcataaatctataagatgtacttctattggcatgcttaatgtgtgtatgtatttatgtgttttgtacacagtgttttattactgaaaatatataaaagagctctaattaattggcttaagaaaataaaagtgcttgaattaaatactttgccagaaaaaaaagactagtcaaatgctttttcaagtttatgtaacttcaataaaatcttttataaataagataactttacaattattgctaaagtatgataatattagaaatgtcttaagaatttccagcatatatttttgtttgcatttattaatcaagcaatttcatacttattgttgccaaatactttaaggtgtcaaaatttgacataagggttacaaaactgtaaaccaagcccaaaacagaatgatctttgcttgtgtaattttttaataaataagacattgatattggtttaatgaaaatagccacatcttgaattaagtaagattatcataacttctaaccctgtggccttaagcaatctagtccacaggcagtaaggtttgttttgggaaaaaactgttatcatttttatttcaaagctaaaccataaagggtgtgaaatggcaacactatccttcaactcattttcaactcatataagtttttttcctcaagttctgtttgttgtggcataatgctaacagtgctttctaaaagctattcagctcctcaaggtccagggactatcacagaagaggtgggtgtgtgagattttaagaactgatactgagagataagttagtttatttacaaattaatcattaatgtcaaagacacactaatgcaagaccaacatatgggcccctgtgtcagattaacaaggttttctggaagcataaactgacttcttaataaagattataaaggttatgaaaggctgaggaaagttatatcttatggtcaagattagaattttatagattgttcataaaattttgaaaaacaaagttatttggcttcatgctattttattagggcttattgtttggcaaattgagtctcctctctcaaagaatgaagatttttgcctttttttgaaatccttgagttaccacattagtcaaatgaatgatttatcttacctgtgatattaagtgttttaaacctttgatatttgagaaattttccaaacaaattataaattatgattttttctgacctaagtaatcctttaatttattagtttccctaacatccaaaaatgacataatttggtttattttgtataaaaattatacaggaaacattgtcaaatatgaaatggtgtttggtctttttgagctgtatttatataagtatgttattgttatgtgttccaaaattatgggaaactcctataattctgatatgacttagtgtgtacgttatcagtaacaattatatgtgttaagttattgtgtgccacagaggtaacaaatttccttgtccattgtgtctttgactgagtctgccctaaaactttttgtcctccacagacaattgttgtcttactttggtcctctttagaaggcgattttatactcagccataaaattctaacaggtgctcttgaaaaaaagtttttgataattttggagattgtgacattagaatggaagaaaaactttcaggactcatggagaactaaaatgttcatgagtatcaagcagaacaggaattaactacatggactgaaataataaaaaactaaagtaatcttttagactttgcttaaaacattgctgatcctttgttttgtttttttttcagagtgaaggaatctttttttttttgagctattaacagcttttaacaatttagtatactcctatgaaaaaaatttagaacgtatttgtttccctctacctgatttttcagaatttggaaactatttgtgagtattttttacttttgtcaatacagttatttgcataagtgcaataagaatctattttcatttttaacaaaacacaattggagaaactggttattttatcaaggcttccactggtatggtgggctttcctttagggaatcaaacttaacttatggagccaataaaaccccttgggaaaactggcctcataccttcatctataaggtccctgtacagggttcctgaactgtgttaagcaaagaatgtaactttctgacaggcccaggagccccaagtttattttggaaccccaagaggagaggaattcacccaactcgtaggtatttgatggtagaaatctatggctttcctcagctttaaaaaagtcctatctgagattctttctataagacaaagttccatcaaagccactttaaaagcctatgtaaataaaaaattattcttcctcctctgtatacaataatcaggccaagtataataaagcaaatcagttgtaccatggtttgtctttagtaaaattgggaaactgaagacagaaaaattatgtttcaaaaataacagtatacctgttgttagattctagtcttgcctaatgtttttcaacttttattactgtctacagtttggactgaattctaatttttcatggcgacacgtcttcaaaatagtgtcttcaggttttttttcctccctttccaccatttttcctagtttggagtcactgtaaactaagtcatgctttcatgaagccctacaaattaagctagacaacttaaactccagaagaaaataacagcaaccaatttacatacataatccactttcatacctgcctactgatttatggacttcagagtaatgggcctatattaattttcaaggatttttcttttgtttggttttgtttttctccctttctccctttattttgtcttcataggacatgagacttcacaacctactaaaaatgaactttcctaataactcaggacctgcttaggaataaaccttccttgccattagagatcagatgaaaacctgagaccagagactcattttcttctaaaatgctttctccaaaagattttttttaaatgtaaaaggaaaataagcctgggggccccaaagtcactaagcaaatcactgcctcccattctattcaaagtcacccctctgctcactgggataaatgcatatctgattgcctccttggagaggctaatcagaaagtcaaaggaatgcctcctccctgcttcaagttggcaaaaataaactttctaaatgtactgagacctgtatcagatatttggggttcacaagattatcaatgaaatattcaaatatttaagaattgttaagcagtcttaattctagtaataaaaaagtagcaaattagtaataacctatatatttattttatatactttatactagctgtaaccttccaaatttaatataaatttattaatttttgagtgatatgagaagagtttacttatatccacttgtctactagtcataagttattttatgaatttgacatcattgattacaaaagactaaatatttaaactgcacatatggtgagaaataatgctacatatgtagtatgtgtaatttcttttcatttgctaactatcaagtgctactttcaggaaaaatttcaagtggcagtgtttgacacaaattcagactattatcagtattgctacttttgtaaatgctaacaatgtaggaaaaaggagcccattgacaattcatgattaacaatacagatgctgaaaatgtagaaaattgtattttgctgcattttgcttaactgatctttcacacttagatgatgcactacctagcattgacagccttgatatatggtcagctatagccagtcattaccatgtctagtaccaaactaaggtactgattttagaattcccaagcaatctttataaactggagtagaatttacaagtgttgaccttgtatttgatatgggagtgttaaagtaactctgtgttttcagcaaaaacttgtatagatcattcagagagggctatgtcagataagaaactaaaacgtaaattgaaaatacacaaagattgtatagattagaaaataagttcctaccatgtttatttatattttctgctccttcctcaatctggagaaggcactaatctgattcttagagcatagtctttgttgggccacatttaataatgcacatagtctaccctaaaagcaggattctatctccatcctttccattacatttttctgcttaagacattagcggcacccaagtcagcagagcagacaagttttttttttttttctctaaatctacttggctaggtgggtacctccagagcagtggctagtcagactaggacattctttctctgaatggcaccctgaacagaacactaaatagacctattccaatacatgggaagtaaaaacagccagattgcttggtaagacgaagctgcatgatgcatttcaaagttttttcgatacctgcttattgttattgtgatagtacagtaacttattaaaatttaactgctttttgataatatctacagtgtatacagtaccttctaaaatcctgtaaaccaaaaggagcaaatgacagggcagaatttagtgatttctatgtacatgctacgataccatgataataccaaacttcactagcacctcttaaatatatttccttctgatcacaatattaatgccaacgttattatcaaccaaaactcctctctttatgattttaagatcttccatatatgtttttgttttgaacagatgtctgagataattagaactatcatagcagttaaattttcaggcagaacatttctgtaatggactcttgaagagtttaacagattcatttagtagccatccacagttaaggcactttatctaaccttttgtgggatctgggcaagggctgatgcaatcatgttggcactttcttctgacatgttactgatcatcgaccccagagaaaacaccacaataccattttctccagagctctgcacaaactcttccatttcctgtgaagaaagaatttgttctatcagaaaagagcaacagcacagaaaacactattgacaggattgttacaaacatctaagatgagaaagtcagaagctattggagtaatttttttaaactgacctaatcattcagtttctttgaaaggagatgtgtaatataatatatgtgggatctttcatgcaaatttgtgtaaatatgtgtgcatatgcatgtatgtatgtgtgtgtaaggaggaaatgaaacaaagctatgacactgcagtaggaggagataatgctagaaaatgttacacccagacactttatttataatattataattactaacataggttattggaaggtagctttacttggcttcaattctaattttttttgtggttctactaaatctcttgtgtttatttggggtagttttattttattttatttttttctgttcagttcttttagttaggagtcattggagccattacatgactatgagcattgaggaaaagttagttacaattggaatgatattatatctacatttatttagcttctagctctctaaccctttatatttcacttaaagttagggtttcctagtcttaccccactacccctcactgcccccgacacccccaccccccaaaaacaccttaaaagctgaagtataagaatcactgacattcagcagtctggtattgtggtttggaatttctgggaaatagttctgagaattccatttataatacagtattatatactatatagttacataattaagtgatcttatttctcaggtcattgcttaggtatgactatgacaccttttgtcctgaaatcacactgtgaatttgatgtgctatgtataactgaatgtgggggaccctcatcatcactttgctgtgtctcacagggggcacttgaaccacagtgggagaggtcaccaggactttctccagtggagatctgctcaccccctagagtagctccctcacactatatgaagctcctggtgaatatgtgtttgctttgaaatgaatgagaattattctgacttgtgtttcctgatgtgtccctgtttttaaacttaaatccattctctaatgccacatcgctcaatgtattctcacaccaaaaaaaaaaaaagagagagagaaagaggaaaagaaatgtagacccataagtttcctggatatcatatcaaaattgtatactcatctttttgttgctgttgtcccttttgttcaaaattctctttttctcagtaaaataatgaccaaccccttctgtcataacaaatatactttctggtcctaatcattgggggaaatttctttataaaactgtttacaaataaaaaaagaaattctaaaatatgtcaattcagaccatatattggtaagtatttttaaaaaatataatttaactttatgacatcttttttttttttccagatggagtctttctctgtcacccaggctggagtgcaatgatgcaatcttggctcattgcaacctctgcctcccaggttaaagcaattctcctgcctcagtctcctgagtagctgggattacaggcacctgccaccacgcctggctaatttttctgtttttagtagagacaggtttcaccatcttggccagactggtcttgacctcctgaccttgtgatccacccgcctcagcctcccgatgtgctgggattacaggcatgagccactgtgcctggcctgacatcagttttaattggagattcagtgtatggctattagagataattcatgaggcatccaggaactcagtgtaattgcagttgcctgtagccacatttaatgtaacttgagttcaatgttttgtctcattcactgccaaaagtctgcttcacccacccagtattgaagtaataaaacatctatttatagacagatcagcactgatctcattctgtgatgtctttatgaaagtaatggtaatagaagatcaatgtaagtagttttataaaagtatgaaaatttagaaaaagaaaatcatttacccatatctctatctcaatttaaaatgtgtgccatttcattatgggtttaattctatttatataactcaatgtacatatgtgatgtttatttagaaaattttattctcattgtatatgcctttttattctacaaaaaaactgtgatcttgttctactcatcattttgttccttagtttccaactatacctgtaccacggctgacagtgtaattaaacattgttttgaaaaaaggattgtaatggcttggtatgcacattatgtaagtttttaaccatttcttaatgtaagatatttgaattatttccagagtttttttaatgagtatttgctaccgatattgaatcttaccatcatgatttattctctgtacagtttcatgtgagtatattataaaggcaatgcctatatgcatttttcaaacacttgatactttttggcaagagtcttattcttttgaaatatacaaacattatctgagaatctaatacataatggaaaagcaagcaaatttgtcgcaacaattattttgtgtacaaaagaattagagaatcagtttcacaattatttacttggattcaagtctaccttctgcaagttaacaacaacggaggctcacacttgtaatcccagcactttgggaggctgaggcatgtggatcacctgaggtcaggagttcaagaccagcctggccaacatggtgaaactctgtctctactaaaaacacaaagattagtcagatgtgttggcaggtgcctgtaatcccagctactcgggaggctgaggcaggagaatcagatcgcttgaacctggggggtggaggtttcagtgagccgagatcatgctagtatcagtaataatcactattgtactactagtcatttatcccttgtccttattctgctactctcttccccctgctactggcactatcactttcttttaatgtgagtgaggaatttttttttgagaataagataagagtacacagaattaccttttaagctagaatattaatgaagagcctccacctttacaatacaactttagctttccagcttgttcaactgactgcccaaacttaaacatttacatttaaacaagtacacagagtatctgttctctaggactttgctagagaatataatcttgatgtgttggaaaatcaatcactattaaatgaagactgatatcttaaatggctggcacatgttagctaatttaaagtattaaaaataatgactgaaataatcataatatcaacaatatttttggatcactggctgtgtgtcagagacaacttaagtgttttatctgtggtaactactttttttccacacagcacaatatgaagttgtgattattattataaaagtagtcatgattgcttaaactcatgtaaaagttcctaaatgatctttacattttacaaacttgcctttttgcaatattatacattgggaatattgggattttttaaaaggaaatctgatcatatctcttcatttcttaactcttttcactcttttcagtagctctccattgtccctatgggtatatcaaattacatatatatatatatatatattttttttttttgagacagattctcactctgttgcccaggctggagtgcaatagcgtgatctcggctctctgcaacctctgcctccggggttcaagtgattctcctgcctcagcttcccaagtagctgctattacagtcacctgccaacatgcctggctaacttttgtatttttagtagagacggggtttcaccatgctggccactctggtctccaactcctgacctcaggtgatccacctgccttggcctcccaaagtgctgggattacaggtgtaagccaccacgcccggcccatcattgacttttactcaaccttttcctgtaaattaaatttggagttcctgggaactgcccttattgcttttctacttttctgccttaatgcaagcctttactttttttttttttgtttatttgtttgtttttgagacagagtctcgctctgtcgcacaggctagagttcagtggtgtggtctcagctcactgcagcctctgctcccagactcaagcaagcctcctgcctcagcctcttaagtagctacgactatgagactacaggcacacaccagcatgcctggctattattttattttttatttttgttagagatgaggttttaccacgtttcccaggctggtctcaaactcctgagcccaagcaatcatgccttctctgcctcccaaagtgcagggattataggtgtgagccaccttgcctggcctctggttttctttttgggtgtttatcaacccctcatcgtttcacctatctctgcacattattgagtactcactttaattgtcaatgagtttgggatctcttctgcatatttctttatcattgtggtctttccttataacactttttagacttttctttttcacttgtttttattctatctttcaaagtacaatgtaaggcatgagggagcagaaactgtgctacctttattctctgaaaatccagcacttacctgtggtttgtattaatcactctacaaatattttttgaagaaatgaatcatactatcttttgggtggcacaatgaaggccttactttaaccaaccctgttttcaaaatctccctagtaaacctctttggtctttaatgataataacattcacatacttgtgatactacagaaatatatgattttctaatggcaagtccttgtttttgacctcccatattcccctcactctgagttaaacactctgaaagaaacatatccagccattccttctgaaaatgtcaagcaaacaaatgaaacaagaatacatttaccttaggcaggggtttggctggtttacagtgaagtcctccaacaaaatcaacatttggtaagaatgggcgaggaaattcaaaatcccaataggttcgaatgagccacatttcagctttccccattgtctcaaataatgtagtgggtcttcctgatggaaaaaaacaaaacaaaacaaaaggtagctaacacgagaattgttatttgaatatgcaggtattttcctgaaaggacttggaataacatacccaaacatatataaaatgtctgtgcattgataaaatatatataaatacatttatatatagtcataatttagattttatttattgcatatgttgctcatatgtatatataaggaaggcaatgtattcagagatctgtaagaagaaatcacatctttaatgtaacatcagtatattcacaatcataaataattattaaaataagtcactaatatggtttgactgtccccacccaaatctcctctcatcttgaattataatccccataatccccatgtgtccagggagggacccagtggcaggtgattggatcatggtgtggattcctccatgctgttctcatgatattgagtgagctctcatgagatctgatagttttataagtgtctagtatttcccctgcttgcacttctctctcctgccactaagtgagaagatccaagcttgcttccccttagcctttcaccatgattctaagtttcttgaggcatcccagtcatgtagaactgagtctattaaacttcttttctttataaattacccagtctcaggtatttctttacagcagtgtgagaatggactaatgtagccactatgaacttaaatacacatttgtcttccctctgaagctgcaatagtaacaaatatacctttaaacaactctttcagttccacaattaattcatcttaccttacccatgaaaacagctttccaggaagtactctagtgtctacagtttattaagctagtcccttgatccttggttctcaaagtaaaccatgagttttttgagctcaacactgaaatctttacacctactactgtcttggttcatcttaagatcttaatataattagatttttaaaataaatatatttacaaatgagaattaaaacattttcagaatttattgacatagagatatgtgctctcccttaatttggcccctattttctttgatggagagatgcagtttaataaaatatagattaaaacttagatgttcactttcaacaagatttcagtttttgaaagaaataattgtcaacctgttattgaaggaatgtataaacattagaaatctcaagttttaggcttctgtttctggagtagagccactatattactcaactgtgaaggaatccttcttacatgaaaaacaaaatttaatttctaaatgaggaaactgaggaactcaaagagaaacaaattcctcaatcctgcattgataatttttctagaaatatgtgtaaatactaaatttatgtgtctgccttcatgaagatgtttcttgaggtatctattgactttttttaaagatgaaaaaatgtatagcaaaatgatatgtgatagtttaaagaaatcattagtgctttacaatgaaggtttatgactctctgggtgtcctgtagtagtgatggccccagggttctaactgattctataaggtcaacattctataatatttttgagactgatagatcatcttacatttgcaattcataatttcccttaaaaacactatcttctgacattatatttatataagctcaccttcaaaggcacagaaaagttagaacttaataagcaccagttagacacatgacttacctagaacttcactataaaactggtcccacttcttcagatcataaatttgaaaccaaaagtcaaaataaagcatatgtatcatattttttatcctctccatgaaaatcatttgatcacttaattctgacataacaacaggtacataggaaggagggaacagaaatcctccaccattcttctcaaatgtgtagccaacagagaatcgaagactgtacagaaagggtatgttaaatagttcagccagtagctcaccacagggattaagggcatctgccagaatgacatcaaactttgactcttgtagtttcatcataagtttcttattcaaaactgcatctttacagagcttgttactgtagtcataatattcccaacacaattcttgtaattgtgaaaaatatgaccaaaatgtattttttgaaacaccatatatccatctatcgagaattttcagaagagaatcttccaaataatttttagttaaagatgtaggataaacttctaatttaatagcagatgatttactggcattgacaagagtagaagccgaagatgtcaacacagtcacctcatgacccctctgaacaagctcttccaggattgtcttcatatttatccaatggctgtattctgtgggccacactagcacctttccacagcttccagagctaaagtaacaactgagctgtatcagcagaaagactgacgtccatttcagagacatcctggtcttatgcaatgcttcttttccagttgttgtttctttctgtcatttctcatacttatatctgaggaaaaatcaatcaagttaaaatataactgctaaaatttgaagtaaatacataatactaacagtctgaataggtgcatgccaaggagaccaacaaaagattgatgacctcatatttattttagtgtgtttggtgttcttttatgtttacaattactctagtcaagcaataatttttatgacctagaatatgtaagtaacctgtcttatgtaattattttataatactgttaagaacagtggcaagtgagaggctcctgcctgttcggtgcccttgacatagagagaagaagtaattatacaactcaaacggcattttttaatatcgtggtgcaagtaatgtcttctaaaactttgttgacacataattcatataccatatgactcaccaattagtgtgtacagttcaatgtttcctagtatattcacagaattttacatccactacaataatcagtattatctccaaaagattctatacaatagcctctaaccccccactctgaaattttgcatccatcctaccctaggcaaccactaatctaatttctatctctatagattagcattttctggaccctttaaaaaataaatgagggttttccagtgatcatggcagatgggatgcaggactagattgcagctccagacagagcagcatgcagaggcttgcattgtgaattttagctgcagatcaactgcaagaacagaccagcaattctgagaggatccacacaccctctgcaggaagagtactgctcctgcaggacctgggagacatcccaaacactgtgagtgccccaacaatggaagtgggaaagggtgatccccctctccagaatacacatccccactggagaagctgaagttctgtttgcaggagaagttcctgactttatgtgaagctgagtcaaattagagaaccaagccaagcaaaatacaggggtagaggaagtagcagaaaggcactgggagctctctggatacccaagcggctcattcctgcctggcatcacagggatctatcaggagggtggccagtgatgcagggggttcaaagattctcctcaggacctgaaggcttgaagggatgagtaactcctcccttctcaggcccagccccaagatgcaagaccacttgcatcagcagcgtgtgtcagcaagatagcagaagcaggaagagagccggccagaagacacttaccctggctggaagagatgtacccctgaagatcaagaaataggccatccaggtactacatagcagtcacaacagactgggacacttactgtttacagaggactacaaaacccctgtcccatcctcacttggggctgatgccattttaggcctcagcccacctgcaaccaggcgttcattaaaacagcatgttgctccacaccgcctcctgttgtctgttggcgcgctgttggggttcaaactgattcaagaaccttacatctggtgccaaatcctaggaggggctcaggtctgtgtcgcttgtggacctatccctccaccccagagagcaggccacagcaattagacagaggaagctcctcagcctccagtcgcctctctgtgcatgcgcatcagccactgatctcgcctactggtaagtttcccttggagcccggttaacagggcaaaatctacatggcctctcttggtttctccagtccaaaaatccaacactgatccaagaaggcgccagcgtgcgccaggcactcgctggtcatctggtcttagggggatgcctctaagccatttcatcccgttccaggaaccaaaaaggcagcggagacgataactccttttatcgtctccctccagctgtccaggatggtctcctttttccctgttctctcgagctacccttcattatgggaaactcccggtcctcaattccaaaaaacagccctccagcctgcctcattaaaaatctgcaaaccttaggcctcaggcaagatatctgccataagtgccttgtcttttttatacgataaagcctggtcgcagtatgaattagataacgggtccaaatggcccgcaaatggaacactcagctttacagttttaactgacttaagcagttattgcagatgactgggaaaatggggagaaattccttgtgtccaggcctttttgcactcagatcacagcccgacctctgcaattcttgcttacctgttcaaatccttcttcattctcgccgccctcattgcctttatcctcccgaccctacctctttttcctcattggatggagcagactgctgtccacccctcccagaccctacccctccatctcaaccaacttcattaactccccaagcttcctcattgtcttctcagccaccatcttcccagccaccatcttcccagccagcatcacccacttcttttcctataccatcctctcctcaggaaaactctagcattgcctgtactcattctccttccttacagccctctcacggagcctgtaaacccatcccgccaccttacacccgtatctatcctccaatgcctatcaactcaaccccccttccctcttcaaaccctcagcaggaaccccttctggcttcttccttctctcctgcccatactagctccggcaccatctttggcccatgccccacccgtactttagcgccagtgctagaatgcccccttcgggaagtagcaggaactgaaggtattgttagagttcatgttcccttctccctcactgatctctctcaaactaacaaaagactcagttcatttccagaagatcctacctcttatattagggagattcagtaccttactcagtcttatgaactaacctggcatgacagctacttatcttctcttccaccctcaccccagaagaccagcaccgtacttggaccctagctcaggtgcatgctaatacaattcatcatcaagctcctgcccagcctactggcacagaggcagttcccaaccaggacccccactgggattatcaagacagggcctctggacacagccatcaagacctcatgattatgtgtctccttgcaggactcaaaaagggtgcccataaagtggtaaactatgaaaaactttcagaaatcaccgaaggtcctgacaaaaacccagccctttttctctcttgtttaactgaagccatgagaaaattaccaacctggacccagccagcccagaaggaaccactatttcaaaccttcagttcctcacccaatctaccatgatatttggcgcaagcttcagaaggttgatgacggccctcaaaccccacagtgggaccttcttaatttagccttcaaagtctttaacagttgtgatgaggaaagtaaaagaaaaaaacagtttccaatgcttgcctttaccctgcaggcccacagggccacagctccatacagaagcctcctagcaaaacacctccacctggcgcctgtttcaagtgtggcaatgaaggctactggtccaggccatgcccaaacccagctgtgctcaccaggctgtgccccctctgtggaggactcagtgaaagtcaggctgtgagcggctccagcaaggatcgcctccatccctttccgagctggccaaaacctcctactcggatctcaatggccttgccactaaagactgacagtgccctggaacagatgtcccagcaactaccattgcttcatctgagccaagggtaaccctgatggtggcaggtaggcatgcatgttttttaaaaattaatattggagcaacctactctgctttacctaaattttcaggacccacccagtcctcccaagtctctgttgtgggaatcaatggacaagtctccaaaccccaagacccccctccacttttctgctccctgaacaccttttccttcagtcactctttcttagtcctgccttcatgcccagctccgctcctaggcagagatattctttcaaaactccacactactctccacttccacattccccatagtacccaacacatcaacccagacccctccaaggcttctaacaggcttctaaccttcttctactcctccgacctcccaccctgaaacatgcaacttttccttatcccccacctgtagttaaccccactgtttgggatacttccacaccctcggtcacagagcaccacacccccatccacatcacccttaaagagcccaccccgttcctatcacagaagcagtatctcatcccccaagcagctctcataggcctaaagcctatcatttctctcctcctcaccagtcacctactctgcccaacaaactctccttttaacacatcagttctacctgttaaaaagccagatggaacttatcacttagtccaggacctcaggctcattaaccaagctgtactcccagtgtgtccagtagtttctaacccatatactttactttcctcacttccctcgaataccacccacttttctgttctaaacctaaatgatgctttttcacaattcctttacaccctgattcccaaaacctctttgcctttacctgggaaaaccccgacacccacctttcaggtcagctcacctggtgcgtactacctcaaggttttagagacagcccccacctttttggacaggcccttgctagtaacttctgtactttatccctaaaatcatcctctcttctttaatatgttaataatctgctcctgtgtagcccctctcaaagagactgcaacacccatacatactatctcccttttaaacctcttggcagaacaggggtatcaggtctcccctaagaaagcccaaatatgcaccccccagtcacctatctaggcctagctcttacccctgaatgcaagggctcacaacagaccacatactccctccttcagtccctcccgcctccacaaactaagcaagaaattctctcttttccaggattagcaggatattttaagctctgggtttcctccttcgctctacttaccaaaccgttgtaccaagctgctaaaggccctctccatgagcctttaaaacctgcacagcctattacccaacctttccatctactccaaaagtctctcatctcagcccccatcctcactctcccagacttcaccaaacctttctccctctataccgatgaatggcgtggagttgcactaggtgttctaacccagtctaagggacccacccggccaggttgttgcctacctccctaaacagcttgaagccacagttctcggatggcctgcctgcccctgagcattggtggcagttgctgtcctcactcttaaaagcctaaaactatctcttcatgccaacctaacagtttattcaacccataacatcaaagacatgttagctcaccgcagtgtactaagtcttttctctgccccacggctcctccagctgtatgctctattcatagaaactccccacatcaccatgctaaccacctcccatctaaacccggccatgctcttacccgaagctacaaccgcccaagactcttcttcacactcttatgtgtgaatactgttcaaacctttcttataccttttccaaacctaacagaaaaatcccttccagatgcgtcctttactcggtttgtagatggcagctccttcctacatcaaggacaccgacatgctggctatgctatagtgtcaccccccaacactattgaagtcaatctgctcctcttaggcaccacctcccaaaaggctgaactcattgccctcactcgagctctcattctagcatccggaaaacagatcaatatattcaaattctccttatgtgttccacgtagtgcactcacactcatccatctggaaagaacggggtttcctcactgcaaacaatactgtcataagtggctctctcatcagcaagctccttcaagctgccaggctcccacagaaagttgccatcattcattgcaggggccaccaaaccccagacaatcctaaattggctggaaatgtgctagcagatcaggtagccaaacaagtagccctactaccctttcgaggccagttgctgtccttgtccttgttctctcctctttacttctaagaagaaaaagatttccaagcccaaaaccttcaaaagcaaggacgatattatgtcaaggaagggtgcttagttattcctcactctcaaagccttcctcacctccaaagcctccacaactctttccatgttggttaacaacctcttgcagcttctccacgctattctcacttgtcgtcacttttccagccatgttcaagaaattatccagtcctgctctatctgccactcaatgtaaccccagggatccctccagcctctgccttttcatacccaccaagcccagggccagttacctggggaagattggcaagtagacttcactcatatgctgcatgataaatgtctctgctatcttctaatccttgtctgtactttctctggctagggagaagtgttcccaacaacttcaaaaggtgcaaatatcatcacacaaactcatcatgcatacagttccctgtttcagactcccaacatccatccagtccgataacagtcctgccttcatcagccacattacccgaggcatctctacatccttaagaataagtaagttctccacacaccctacacacctcaatcttcaggcaaagttgaaaaaattaactctgtccttaaagcctaactcatcaagccggctctagaaacctgcgagtcatggacaaaaaaatctcccttttgccctcatgagactttgcacaacaccaaaagcaccctctttttttgtttttgtttttgtttttgttttgttttgttttgtttttattatactttaagttttagggtacatgtgcacaacgtgcaggttagttacatatgcatacatgtgccatgttggtgtgctgcacccattaactcgtcatttaacattaggtatatctcctaatgctattcctcccccctccccccaccccataacagtccccagtgtgtgatgttccccttcctgtgtccatgtgttctcattgttcaattcccacctatgagtgagaacatgtggtgtttggttttttgtccttgcaatactttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgcagcaataaacatacatgtgcatgtgtctttatagcagcatgatttatagtcctttgggtatatacccagtaatgggatggctgggtcaagtggtatttctagttctagatccctgaggaatcgccacactgacttccacaatggttgaactagtttacagtcccaccaacagtgtaaaagtgttcctatttctccacatcctccctggcacctgttgtttcctgacttttaatgattgccattctaactggtgtgagatggtatctcattgtggttttgatttgcaattctctgatggccagtgatgatgagcattttttcatgtgtctgttggctgcataaatgtcttcttttgagaagtgtctgttcatatcctttgcccagtttttgatgcggttgtttgtttttttcttgtaaatttgtttgagttcattgtagattctggatattagccctttgtcagatgagtagattgcaaaaatgttctcccattctgtaggttgcctgttcactctgatggtagtttctgttgctgttcagaagctctttagtttaataagatcccatttgccaattttggcttttgttgccgttgcttttggtgttttagacgtgaagtccttgcccatgcctaatgtcctcaaagtattgcctaggttttcttctagggtttctatggttttaggtcaaacatgtaagtctttaatccatcttgaattaatttttgtataaggtgtaaggaagggatccattttcagctttctacatatggctagccagttttcccagcaccatttattaattagggaatcgtttccccatttgtggtttttgttaagtatgtcaaagttcagatggttgtagatatgtggcattatttctgagggctctgttctgttcccttggtctatatctctgttttggtaccagtaccatgctgttttggttactgtagccttgtagtatagtttgaagtcaagtagtgtgatgcctccagctttgttcttttggcttaggattgacttggcaatgtgggctcttttttggttctatatgaactttaaagtagttttttccaattctgtgaagaaagtcattggtagcttgatggggatggcattgaatctataaattaccttgggcagtatggccattttcatgatattgattcttccttcccatgtgcatggaatgttcttctatttgtttgtatcctcttttatttcattgagcagtggtttgttgttctccttgaaaaggtccttcacatcccttgtaatttggattcctaggtattttattctctttgaagcaattgtgaatgggagttcattcatgatttggctctctttttgtctgttattggtgtataagaatgcttgtgatttttacacattgattttgtatcctcagactttggtgaagttgcctatcagcttaaggagattttgggctgagatgatggggttttctagatatacaattatgtcatctgcaaacagggacaatttgacttcctcttttcctaattgaataccctttatttccttctcctgcctgattgccccggccagaacttccaacactatgttgaataggagtggtgagagagggcatccctttcttgtgccaattttcaaagggaattcttccagtttttgcccattcagtatgatattggctctgggttgctcatagatagctcttagtattttgagatacatcccatcaatacctaattcattgagagtttttagcaagaagcgtcgttgaattttgtcaaaggccttttctgcatctattgagataatcatgtggtttttgtcattggttctgtttacatgctggattaagtttattgatttgcatatgtagaaccagctttgcatcccagggatgaagcccacttgatcatggtggataagctttttgatgtgctgctggattcagtttgccagtattttactgaggatttttccattgatgttcatcagggatattggtctaaattctctttttttttgctgtatctctgcgaggcttcagtattgggatgatgctggcctcataaaatgagctagggaggatttcctctttttctattgattggaatagtttcagaaagaacggtaccagctcctccttgtgcctctggtagaattcggctgtgaatccatctggtcctggactttttttggttggtaagctattaattattgcctcaatttcagagcctgttatcagtctattcagagattcaacttcttcctggtttagtcttgtgagggtgtatgtgttgaggaatttatccatttcttccagattttctagtttatttgcatagaggtgtttacagtattatgtgatggtagtttgtatttctctgggattggtggtgatatccccttaatcattttttattgcatctatttgattcttctctcttttcttctttattagtcttgctaacgatgtattaattttgttgatcctttcaaaaaaccagttcctggatttattgattttttgaaaggtttttgtgtctctatttccttcagttctactctgatcttagttatttcttgctgtctgctagcttttgaatgtgtttgctcttgcttctctagctcttttaattgtaatgttagggtgtcaattttagatctttcctgcttcctcttgtggggatgtagtgctataaatttccctcgacacactgctttgaatgtgtcccagagattctggtatgttgtgtctttgttctcgttggtttcaaagaacatctttatttctgccttcatttcgttatgtacccagtagtcattcaggagcaggttgttcagtttacatgtagttgagtggttttgagtgagtttcttaatcctgagttctagtttgattgcactgtggtctgagagacagtttgttataatttctgttcttttacatttgctgaggagagctttacttccaactatgtagtcaattttggaatagatgtggtgtggcgctgaaaagaatgtatattctgttgatttggggtggagagttctgtaaatgtctatcaggtcaccttggtgcagagctgagttcagttcctggatatccttgttaactttctgccttgttgatctgtctaatgtttacagtcaggtgttaaagtctcctattattattgtgtgggagtctaagtctctttgtaggtctctaaggacttgctttatgaatctgggtgcccttgtattgggtgcatatatatttaggatagttagctcttcttgttgaattgatccctttaccattatgtaatggccttctttgtctcttttgatctttgttgttttaaagtctgttttatcagacactaggattccaacccctgcctttttttgttttccatttgctcggtagatcttcctccatccctttattttgagcctatgtgtgtctctgcacgtcagatgggtttcctgaaaacagcacactgatgggtcttgactctttatccaatttgccagtctgtggagtatttaacccatttacatttatttttaaatgtattggagtatttagcccatttacatttaaagttaatattgttatgtgtgaatttgatcctgtcattatgatgttagctggttattttgctcattagttgatgcagtttcttcctagccatgacggtctttacaatttggcatcttttgcagtggctgctactagttgttcctttccatgtttagtgcttccttcaggagctcttttagggcaggcctggtggtgacaaaatctctcagtatttgcttgtctgtaaaggattttatttctccttcacttatgaagcttagtttggcgggatatgaaattctggattgaaaattcttttctttaagaatgttgaatactggcccccactctcttctggcttgtagagtttctgtggagagatctgctgttagtctgatgggcttccctttgtgggtaacccgacctttctctctggctgcccttaacattttttccttcatttcaacattggtgaatctgacaattatgtgtcttggagttgctcttctcgatgagtatctttgtgttgttctctgtatttcccgaatttgaatattggcctgcattgctagattggggaagttctcctggataatatcctgcagagtgttttccaagttacttccattctccccgtcactttcaggttcaccaatcagatgtagatttggtcttttcacagagtcccatatttcttggaggctttgttcatttctttttattattttttctctaaacttctcttctcatttcatttcattcatttgatcttccatcactgataccctttcttccagttgattgaattggctactgatgcttgtgtattcatcaagtagtctcatcctgtggttttcagctccatcaagtcctttaaggacttctctgcactggttgctctagttagccatttgtctaattttttttcaaggtttttaacttctttgccatgggtttgaatttcctcctttagcttggagtagtttgatcatctgaagccttcttctctcaactcatcaaagtcattctccatccagctttgttccatttctggtgaggagctgcattcctttggaggaggagaggtgctctgatttttagaatttccagtttttctactctttttttttccctatctttgtggttttatctacctttggtctttgatgatggtgatgtacagatggggttttggtgtggatgtcctttctgtttgttggttttccttctaacagttaggaccctcagctgcaggtatgttggagtttgctggaggtccgctccagaccctgtttgccttggtatcagcagtggatgctgcagaacagcggatattggtgaacagcaaatgttgctgtctgattgttcctctggaagttttgtctcagaggagtacccggccatgtgaggtgtcagtctgcccctacaggggagtgcctcccatttaggctactcagttgtcagagacccactggaggaggcagtctgtcctttctcagatctgcagctgcatgctgggagaaccaatactctcttcaaggccatcagacagggacacttaagtctgcagaggtttctgcttccttttatttggctatgctttgttcccagaggtggagtctacagaagcaagcaggcatccttgagttgcagttggctccacccagttcgagcttcccagctgctttgtttacctactcaagcctcagcaatgtcaggcacccctcccccagcctcgctgccaccttgcagtttgatctcagactgctgtgctaggtatgagtggggctctgtgggcataggaccctctgagccaggcatgggatgtaatctcctggtgtgccgttcactaagactgttggaaaagcgcagtattatattaagagtgacctgattttccaggtgccatctgtcaccgctttctttgattagaaaagggaattccctgaccccttgcacttcctgggtgaggcaatgcctcaccctgctttggctcatgctcggtgcactgtacccactgtcctgcacccactgtctgacactccccagtgagatgaacctggtacctcagttggaaatgcagaaatcacccatcttctgcatcactcatgctgagagctgtagactggagctgttcctattcggcctagctaattattaatatttcttttcttatagtaattttggttttggtttgttcttgcttttctagtcatttgagatagatcattacattttttatatgaaacctttctccttttcttgtgtaggcatttcttgttctaaacttgtctcttaatagtgcttctgttgaatctcacagattttgctattgcatgatgtgatctttctttgttttaagcaatttcaaaattgtttcttttttatctattggttataaggaatatgttgttaaattttcatggatttttctagttttgtcttggcattgattttataatttatttcattgtgttcagataaaataattagtaaaatttttattttttaaaatttgttgagacttgcttaatgtcctcatatatggttaattctggggatgttatatgtgctataaaaagaatcttacattctgcagctgttggttaaaatgttctgtaaatatcaactacttcaatttggtctatggtacagtttaaatctcatgttgctttattgtctaaatatctgtccaatgctgaaaaggtgatggtgacatcctcaactattattggacttaggtctatctctcctttcaggtataataatatttgcttcatatatctcagcggttcatggttggttgcatatatatttacatttttgtctttttgaacaattgattcatttattatcatattaagtctctcttttcctctcaaaattttggcttaaagtttgtgttttgctgaggtaagtgtagctatttctgcttgatttgggtttctgtttgcatagcatatctatttcatcttttcaattgcagtctatgtgtaactttattggtgagatgagtatcttttaggctgaatattgttgagtcttgttttttaatccatcaatctacgttttcagttgtgtaatttaatccacttattttcaaggtatttatttatttataggtaaaggcttattcttttatttttttctgtttattttgtatctcccttattccttaatttctctattacttattttgacagtttgatagttttctatactgataaagtttgattattttttctttcacctttgtctgttggctgtatgagtgagttatataattttgtgtgtttttatgaagtgtattatcatcttttcaccttcagatgttagacttcctcaaatattccttttaaggctggtttaatggtaataaattctttatgtttttgcttgtttgagaaatactttattcctctgtctctgttttttttgtaggatcaaagtttgctttatataatattcttcattgacatgattataaaacaaattttatcacttagcatatattttcctattctttcctggcctataagttaatgctgagaaatccactattagctgaatggagattcccttatagatgatgtgtcagctttcttctgccatttttagaacacctgctttgcatttgacttgataatttgacgatatgtgcatcagtgaagacctttttggattgaagtaacttggtggaactttcagcttcttggatctagatgttcatcttttgtcaataacttaagaagctttctgctattatttcattgaatataatttctatgctgtttatcttctcattctagaattttcatcatgttaattttttttcttttttacttagtgatgttgcataaattctgtaggattactttattctttttcttctttcttgtctatgtgagtcatttcaaaaacatggtaatagttggaaattatttcctctgctttgtctcttatgttcttgaagctctcaatagtatatttttaaaaaaatttgttcattgctttaaagtattttatatttttgtgggtacatagttggtggatatgcttacggggtacatgagatattttgatccaagcatgttctagtgaaaaatttttacaatgaacaattcaataaagttgcagaacatgaaattaacagacaaaatcaataacatttctatttgcctacaatgagcagctgaaaaagaaatcaaaaaagtattcccatttacaatagtcacaaataaaattgaacatctaggaattaaaggactgaaagatctctataatgaaaactactgatgtaagaaattaacactgatgtaagaaaacactgatgtaagaaattagagggtaccaagaaatgaaaaaatattccatgttcattgattagatgaataaatattgttaacatttctatattaagcaaaacaatctactgatgcaataaaatcatgaaaataccaattacattcttcacagaaatagaaaaaaatctcaaaatgtatatgaaaccggaaaagacccagaatagtcaaaggtatcctaagcaaaagaaaccaacttggagtcacattatctgacttcatattacactacgcacctatagtaaccaaaccagcatgttactgccataaaaacagacacagagatcaatgaaacagaatagagaacccagaaaacaatctacacacctgcagtgaactcattttcatcaaagttgccattaacatacacagaaaaaaagacagtctctttaataaatggtgctgggaaaacagaatatctatatgcagaagaatgaaactagatccctagctctatccatatacaaaaatcaaataaaaatggtttaaaggcttatatctcagacctcaaattatgaactactacaagaaaacattaaagaaaatctccaggatgtttttctgggccaaaatttcttgggttataccccataatcacaggcaaagtaaaaatgaacaaatgagatcacatcaagttaatcagcttctattcagcaaaggaaacaatcaacaagtgaagagacagtccacagaatgggaaaaatatttacaaactatccatctgacaaggaattaataaccagaatatataaggggctcaaaccctctataggaaaagataaaaaaatggacaaagaatttgaatagagatgtttctcaaaagtaaacagaaaagtggcaaacagacatgtgaaaagatgctcaatatcactgatcatcagagaaagtcaaatcacaactaaaatgagacatcttctcacaccatttaaagtagcttatacccaaaagacagacaaaaataaatgctgatggggatgtgaagaaaaaggaaccctatacaattttggtgggagtgaaaattagtaaagaccactatggagaacagttgacggttcctcaaaaaaatgaaaaatagagctaccatatgatccagcaatctcattgctagatatatacccaaaagaaataaatcagtatgtcaaagagatacccgcactcccatgtttgttgcactatttacaatagctaagatttagaattagcgtgaatgtccatcaacaaatgaatgaagaacatgtgttgcatagacacaatggagtaccattcagccatgaaaaagaatgagatccattcattttcaacaacatggatggaactggagctcattgtgctaagtgaaataagccaggcacagaaagacaaacatggtatgttatcacttatttgtgggatctaaaacttaattaaactaatgaacatagaaagtagaaggctgattacttgagcctgggaagggtactgggggcatgggggtaagcagggattttaacaggtacgtaaaaaggaataagacatactatttgatcacacaacagggtgactatagtcaataataacttcactgtacatttttaaataactaaaatagtgtaattatattgtgcataagacaaagtaaaaatgcttgaggggatagatactccattctccataatatgcttatttccaattgcatccctgtatcaaagtatctcatgtactccacaaatatatacatttactaggtaaccacaaaaatttttaaaaattgaaaatttaaaaatttgaaagatatacttaatggaaaaacaagcaatttgtaatacaattattttatgtaataaacaattaggggacaggtttcaaaaactattgacttggatttagtaacaacagtaagtattagcaattatcatgattgtactattagtcattctttcacttgtcctacttccctaccaactcttccgtttcctggtggcactattaatttcccttaatgtacatgggaaaattattaaaatataaagttagattgctttgaatttttattagtatttcatcaacttttatctcacgagaaagttaccatgtagaccttatataatttgcattcaacatggatattatgttttagccattgaataagattttagttgtatgttgatgctaataagaaggtaaacagaaatgatcccctaagagactgtataataatgttgcaaagaataattgctatctatatatatcttaaaagtgtgatattaatttaaaacacatgagattcttgtgttctctcataaggaatattctatagaataaataattgttattatgaactaagggcacttttcagatacaagtggtagaaattatttggtttttattaggcaagcacttttcatttttttcttggattctctgagatgcaggtatgacgttgagacataagttgccccagggagctttcctgagttgtcctgcaggcttggcataaggtggaaaaacacctgttcttatagggtaaaatgacctttttttgctgtaacatgtagacctctggaatctcagggatgaatggtttaaatgctggagtgaaagcaagtaaacactgggttttgttgcaaatattttgggggcacaatttctttttatgttgaagaatggtgtacattttaagctagaatactggtgaagagccccaatccttacaatacatcattagcatttcaccttgctcatctgtttgcaaaaacttctgcttctgcttttaaacaagtccacaggatatctgtcatctataacattgctagagaatgtaatgttgatgtgctagatgataatcagtatctattaaatgaggaatgatatctcaggtgactggcatatgataggtaattaatgttattggaaataacaaaaataaccaaaattgcaatattaatatttctggatcactgacttagtgccagacacattttaagtgttttacctgctttaacttttttccacaatacaatataaagctggcaaaagtacacataaatatctctatcaacatgctggtatatttttctatcatttgctgcctgattttattaaaaaaattctaaattgtgtattctttttattctgaccctctgcagtctaattcattgaatatcttggaaactttttaaaggaaggaaatataatcagatctctccatttgttaactctttttagtagcttcccaatgccataataaatatttcaagatcctaataattatttggctccaacttgcctcttcagaatcatctgtttcttagtattcttctgcaaactaaacttgaagacttgagaactgtctttactactttgcctgcttttccttttgtgtcttcctctccccctcattcatcacctatttcttcacacctttcagttctcatcttgattatccatgtctccagtatactttctgttatcccaactggatatatccttgttattgtggtactgaagataatgcttttcacacattttattacttgcttatattttatctttcaacatagagtttaaggaatgtggggacagaaactatgtctacttttcttgtcttcttaaaatccaaagcagtggtttgtgtgaagcactttataagaagtattgtttggttgaataactaatactttcttatatgttgcaaaatgaaggctttaatttgaacattactaggttcagatagtctctagtagtactcttttttctgtagtaataatgaaattcatataattgtgatgatatagaaataggaatctttaattggcatctggtttaccccacccactaaacatctttctttcacttcaagcaaaaacactgaaagaagaatatagtatcattcccaccaaaaatttaagacaaacaaaacaaaacaaaacaaaacaaacaggtttttttttttttttttttttttttttttttacctttggcagggattttgcaggtttgccgtgaagttttccaacaaagtgaacattttgtaagtgtgggtgaggaaattaaaaattcctgtagttttgaagaagctttgtttcacttttctccattatctcagataatgtagtattttttcataatgggaaaaaggaaaacaaaggcatatgacacaagataattgttatgagaatacaactgataattatctgaaaggagttagaataatgtagccaaagatatataaattgtctatgcttagataaaacaatatacatgtatttatacctggggataatttagtttttgtgcattatctattttgctcatatgtatttacaagaaagaccaagtgctaagagaattgtgggagaaaacttattcttctatcacatcagtgtattcgccatcgtaaaccataattaaaataaaccttagagaataaaacatgcatttgtttactctataaagcagcaatagtaatagatatacacttaaaacaagtctttgaggtccatgatcaatggattctactctactcataaaaaacaattttctaagaagtactcaatttttttcaaaaattaagctagtcccttgatcttttgttcttcaagtgaactgttgagtattttgtgagtatggctgaaatccttgtacctactactgctttgggttcatgctaaggtcttaataatgttagattttaagtaaacatattgtcaaatagcagctgaaattttttcagaaattattgaaatagagacttttgcctaacatggatttcactcatattgttcttagtgaagagacatagttaaaaaaaaaactatacagaagtaacttgatgttcacatttcaacagatgtttgactttaagacaaatgattttcaatcctttagtgaaggagtataaagatactagaaacttcaaattacctgcattgatttttgagtctttgatagagaaattgtatcgttcaattgtgaaggaaacattatggtactgtgggaaaatattttaatttctaaataagggacctgagatacacaattcaaaacaatcccctcaatgctaactagatagttgtgctagaaaaatgcataactcctcaatctacatgtctgcattcagcaggatgtttcttgatgtgtctaatgacttttcttaaatgaaaaatatgtcaagtaaaatggatgtgtgattgctgaaagaaatcctaatgacattaatttataggtttatgagttcctggagtgtgctgtattagtgatgaccacagggttctaacagatgctataatgtaagtctttccataatatttgtgagattgatagattattttatattttcatttcctcatttcttttattgaaaaacagtacttctctgactttatacgtacttaccttctgttttagttaattttcacactgttgacaaagacatactcaagatgggataaaaagaagtttgaaggactcacagttccacgtggctgggaaggcatcacaatcatggtggaatgcaaagagcaagccacgtcttacatggatggcagcaggcaaagagagagaacttgtgcagggaaactaccccttataaaaccatcagctattgtcagacttattcactatcatgagaacagcacaggaaagacctgcctccatgattcaattacctcttactaggaccctctcacagcacatgggaatacaagatgagatgtgggtggggacacagtcaagccatgtcattctgcccctggcccctcccaaatctcatgtccccacatttcaaaaccaatcatgccttacagacagtcctccaaagtcttaactaatttcagtattaactcagaggtccacagcccaaagtctcatctgagatgagacaagtgtcttctgcctatgaacctgtagaatcaaaagcaagttagttaattcccagatacaatgagggtaccagcattggataaatacagatatttcaaatgggagaaattggctaaaatgaaggggctacaggccccatgcatgccagaaatccaacagggcagtcattaagccttaaaattacaaaatgatcttttttgacttcatgtctcacatccaggtcacactgatgcaagaggtgggtttccatggccttgggcagctccacacctgtggctttgcagggtgcagcctccctcccagctgctttaaagggctggcattgagtgtctttagcttttccaggtgcatggtgcaagttgttggtggatctaccactcaggtgtctggaggatggtggcccttttctcacagctcctttaggcagtgtctgagaagcaactcagtgggagttccaactccacattttccttcttgaagtccctaggctacacagaatactgggacgatttttttctttctagcccaccaggcctgtgatggaaggggctgccgtgaaggcctgacatgctctgaagacatttcccccattgtcttggtgattaacatttggctcctcattacttatgcaaatttctgcagccagcttgaatttttcctcagaagaagttaactcttatggtttaatgtaaacacagtatattaaaagtctaagtatgtgcatggcaaagagacaaacaacttgctctttacttgagtctttaatgtcccttttatgtttgtaaatgctattatccaggtagtatcaataattttgtgtggatgagtcacttattttatgtaatatattttacaatagtgtcaagaacattcacagtgagaagttcctttagttctgcaatcactttgagatggaattaaagatgaaaataattatatgagtatatcagcatttcttggatattgtgcttcaaggaattttttggtaaaagttgacatataattgctatgctatacaatttactgattattttgtaaaatccattatttgtggtatattcacagaattgtacatccatgacaacaatcagtttcagagcacttttatttgtatcacaaaataaaccctgtactctttagtattttttcctcaccctgagtttctgcatttctcctgccctgctcaattgctaattaaatttgtatctatagatttgcctattctggaaattttaaaataaatataatcgtacaatatatagtttcttgtgactggcttccttcatttagcataacattttaaaggttcatttatgatgtagcatatgtaaggacttcattcctttttaatggcaaaataaacattttatatatgagcatacacattttatcgatttatttatcagttgatggacattaatttttccctatttttggctagtatgaataatgatgcttatgaacaagcttagtgtaactgtgttttcatttctgtcagatacatattcttagaagtagaattgctgtgttgtgtttccttgcatgtttagctataaaaggttaaactgtacgtgtaaacttttgagaaattgctagactgttttccaatgtggttgcaccattttccattcccatcagcaatgtgtaagtgttacaatgtctccacatcgttttcaacaaatgattatgtgtctttttattacagctaggctggtgggttgaagtagtgtcttgtggggaaaagaaagagagatcagactgttactgtgtctatgtagaaagaagtagacataagagactccattttgttctgtactaagaaaaaatcttctgccttgagatgcagttaatcgataacactagccccaaccctgtgctggcagagacacgtgctgtgttgactcaaggtttaatggatttagggctatgcagtatgtgctttgttaaacaagtgcttgaaggcaatatgtttgttagaagtcatcaccactctctaatctcaagtacccaggcacacaatacactgcggaaggccacagggacctctgcttaggaaagccaggtattgtaaaaggtttctccccatgcgatagcctgagatatggcctcgtgggaagggaaagacctgaccgtcccccagcccaacacccgtaaagggtctgtgctgaggaggattagtaaaagaggaaggcctctttgcagttgagataagaggaagtcatctgtctcctgctaatccctgggcaatggaatgtctcattgtaaaacccgattgcatgttccatttactaagataggagaaaaccaccttagggctggaggtaagacatgctggtgacaatactgctctttaatgcaccgagatgtttatgtatgtgcacatcaaagcacagcaccttttcttaaccttgtttatgacacagagacatttgttcacatgttttcctgctgaccctctccccactataaccctattgtcctgccacatccccctctcgagatagtagagataatgatcaaaaaatactgagggaactcagagaccagtgccagtgtgggtcctctgtatgctaagtgccggtccccagggcccacttttctttctctatactttgtctctctgtctctttcttttctcagtctcttggcccacctgacaagaaacacccacaggtgtggaggggctggcccccttcagtatctcattgttgattatatttccttggtgtctaatgatgttgaacattttgactttgcttataagccactgtattttttttcttttttggagaaatttctattcacatccattgcccatttttaattaatttctttttcttattaagttgtaagtcgtatttctgatacaagtacttcattagttatatcatttgaaaatagattctaagattatgtgggcttttgttttcttgatgctgtcctttgaagcacaaaagtactaaatttgataaagacctatttatatatttttcatatttgattgcttatgcttttgatgtcatatgtaagaaaccactgccaaattcaaagccatgaagattatcttctgtgtgttctttttggaattttatgattctacctcttaaatttaagcctttgacctacttttagtagttttgtaaatggcttgagaccagaagtcaaactttattcttttgtttgtgggcaatccgttattcaataagcatttgttcaagactgttcaattttttcattgaattgttttggcatctttgtaaaaaaccataaatatgtgggtatgtttctgggttctaaaatctattttgtttgtatatatgtctatttgtatgcctataccaggctcatttgattattatagatttgtagttggctttgaaagaagaaagtgtaaatcttccaactttgttattattattattattattttcagacaggatcttactctgtttcccaggctgaagtagagtggtgtgatcatggctcactgcagccttgaactcccaggctcaagcaatcctatcaccttagcctactgagttgctaggaccacaggcatgtgtcacctctcctggctaatatattattattagtattataaagacaagagtctccttatgttgcccaggctggtcttaaactcctttgctcaagtgatctacctgccttggcatcacaaagtacaactttgttctttattttaagacttttttggctatctttaggtttcttgaatatctttgtgaatttcagaattagtttgtcaatttactggaagaagccagttgggattttgatagggattgcattaaatctgtatatctatttggggagtggagtatggacactacaacaatactgtgttttaatctgtgaacatgagatgtctttccatttatttacatcttttaaatttctttcctctatgctttacagtatccataatgcaagttttacacttattttgttaaaattgattcctaatagttatattcttttggatgttatttgaagtgcaattgttttcttaatttcattttggatatttcattgcaattatgtaaagtaatttttttgtttattgatcttttatcctgaaaatttgctttgtttattgttccaatattttttctagcagattcctaaagattttctagatgtaaggtcatgtcatatgccaaaagtttaacttctttcttttcaatgtagatttatttttttcattttcttgcctttatcttgactagaagctccattaaaatattcaatatagataaagagtggatttagtctttctccattaagtatgatgttagctgtgcattttttacagataacacttaccagtttgagaaagtttccctctatccctactttacggggtactgttataatgaaggatattgaattttattaaattaatttttctgcatttattgagatgatcatgcagttttatttttctgttctaattacattttgtattatgttaatagagattttaacgttaaagcaactttgcatttttaataaaacttttacttattcagggtatataattgcttctgtatattcttacattcattttgctagcaaattttgtggatttctgagttcataatcataagatttatcgatctgtagtttttattttttgtgatatctttgtgtggttttactagaaggaattagttaaatatgttgataatgcatttttcttttctgtgatttgaaggattatttttgaggaattgttaatttttctgctttaaatgacttatagatttcaaaataaaggcatcttgacctaggcaattctttgtgggttgtattttggaccaattcagcctctctttttgttataggtctattcagatgttctgtttctttttgaatcagtttaatatattttcttgtctgtgtcttcctgtagtagaatttatgtcaaattaagttgggagtgggtgagggagcagttcatggttgaaattaataggctctcattatttttaccaggacttagtagattttcttgaataaatattgctaatattacgctttataattttaggtcaatgcctggacactttaattttttatagaaaacacaatattttaatgctaaagatgtgtttaaattgtttcttttttacaattgtgatgttctatgaagatttaaacttttgactgttaacagatgatttaaatagaaatgtagcatatgtactcagtgtacatgtgtatattcagcttgtcagcattgagttatctttcataaacttatatttatttatttgacacaaccaggtgggaggggttcccagagaaacaccagagagcctgtgcactgggaggagtgcacactggggtggagccacagaagttcatatgatttgcagtgaggaggagcccggcccctcctcttcttggatggaacctggaattcagtctgtgaggtggcaaacccaccggcaggaaaacacactctctcacttcactaagagcctctgttttgccttttcttcctttttacctaacaaaactctgcattattcaccttcaaagtccgtgtgcctaatttttcatggccatgtgacaagaaccttgcttttagttgaactaagaaaaagtcccacaacatatagatacacacacacgcacacacacacacaggcaaaaatgcaaaaacattcctcattttattttgttttacagatatggtcttttttacaaattgaaagcttattgctgccctgcattgggcaagtttaccagtgccatctttccaacaggatgtgctaactctgtcactgtggcacattttggtaaatttcacaaagttccaaacatttttattattattatatttattatgatgagttgtgataactgattgttgattttactgtagtattgtgttgcgggcaccagaaactgtattgggataatacgataaacttaactgataagtgctggtgtcttctgactgctctaccaaccagcctttcccccatttctctctctctccttaggcctctctatttcccgaggcacagcaatgttgaaatcaggcaaattagtaatcctacaaatggcctctaaatgttcaagggaaaggaaggctctgtcatctcaatatcaaaagctggaaatgattaaacttattaagaaaggcatgttgaaagctgatacaggctcagatctgtacctcttatgccaaatagttagccaagttgtgaatataaaaaaaaaatttgggaaagacattaaaagtgctacacatgtacacatgaatgatatgaaagtgcaacagccttgttggctggataaaagatcaaaccagtgacaatagtccccaaatttagacaaagcctaaaccagaacaaggccataattctctccaatgctgacaggggtgaagaagaaatctttgaatctagcagtggttggttcacgaagtttaagggaataaaccatctccataacataaaagtgcaaaataaaagaagctacagaagattatccagaagatgtagccaaaatagttactgaaagtggccacactaaacaggagatttttccttgtgtacagagcatctttctcttgaaagaagataacatttagcttttttatatcttcacaggagaagtcaatgtctagcttcaatgcttcaaaggacaggatgactctttcattagaggctaatgcagctggtggcttgaagttgaagccaattttttttttttttttagatggagtcttgctctgtcacccaggctggagtgcagtggcaccatctcagttcagtgcaagctccacctcccaggttcatgccattctcctgcctcagcctcccgagtagctgagactacaggcaaccgccaccacgcctggctaattttttgtatttttagtagagacggggtttcactgtggtcttgatctcctgacttcatgatccacccacctcggcctcccaaagtggtgggattacaggcatgagccaccgcacccggttgaagtcactgtttatttaccatttggaatatcctagggccttagataaattattctaaatctactctctctgtgctctattaatggaatatcaaagcttggttgataacacatttctttacagcataaattactaaatattttaatcccactgttgagatctattgaccagaaagaaatattcctttagaaatattagcattcattgacaatgtacctggtcacccaagagctcttatggagatatacagggagatcaatgttgtttttatgcctggtaatacaacattcattctgtaacacatatatcaaaaagtaatttcaacttttaagtcaattaaggaataagtttcgtaagattattgctgccattaacagcaatttctctgttggacgttgtcaaagtaaattcaacactttctggaaaagtttcacctttctagatgatattaagaacatttgagtcattaaatgaagtaaacatatcaacattaacaggaatttggcagaatttgatttcaaatatcatagataatgttgagagcttcaagaattcaatggaagaagtaaccacagatatggtagaaatagtaagggaactattactggaattaaaagaagaacctgaagttgtgactgaattgctataatctcatgataaaacttgaatagatgagttctttcttatggatcagcaaaaaaatttggtatagtgagatagaacctactcctggtgaagatgctgtgaacattgttgaaatgacaacaaagtatttagaatattacttaaggttatttgataaagcagcagtagggtttaagtggattgattccaactttaaaagaagttctatcatgagtaaaatgctaccaaattgcattgcatgctgcagataaatccaagtcaaaatcacaatgagatgctaactcaagccagtcagaatggctatttttaataagtcaaaaacaacagatgctggtgagattgtggagaaaaaggaacacttttacactgttggtgagagtttaaatttgttcaaccattgtgaaagacagtgtggtgattcctgaaagacctagaggcagaaatataatttttcccagcaatcccattactaggtgtatacccaaagtaacataaattgttctattataaagacacatgcatgcatatgttcgttgtggcaatattcacaatagcaaagacatggactcaacctaaatgcccatcaatgacagactggacaaagaaaatgtggtacatattctccttggaatactatgcatccctaaaaaagaatgagatcatatcctttgcagggacatggttggagttggaggctgttattcatagcaaaataatgcagaaacagataaccaaataccacatgtcctaacttatatgtgatagctaaataatgagaagatatggatacatggggggtaaaaacacacagtggggacttttggaggtcaggggatgcgaggagggagaggatcagaaagaatagctaatggattctaggcttaatacctgggtaatgggatgatctgtgcagcaaaccacgatggcacacgtttaccttgtaacaaacctggacatcctgcacatgtaccttgaactttaaataaaagttggaaatttttaaagaaggaaggtcaatgggtgcagcaaacattatttttgtctttttaaaagacattgccacagctccccaaactttcagcagccaccaccctgattagttagcagctgtcatcatcaatgcaagaccctccacctacaaaatgattacaactcactgcaggctcagatgattgttaggatttttaaagcaatgaagtattttcattacagtgtgtacattatttgtaacatatttatattgcagacttaagagactacagtatagtgtacacataacatctatatgccatggaaaaccagaaaattttgtttgacttactttacttcagtgttctgggaccaaatctgcaatatcttggaagtatgtcttgtataagtgaaaataaaatgagatctactcttttaaaagtattttaagtgtatgatacattattgttaactatggccacaatgttgtgcagcagtgctctgaaacctgctcatcttatttttactggaactttatactcattgaaaagcaactctcaatttcctccattctccagccactggtaacctccattctactctccgtttctttgagtttgactgtttcaaatttcttacacaagtagaatcatagagtatgtgtcccattgagactggcttatttcacttaaaattatttcctgaaggttcatctatgttgttacatattgcaggatgggtggatcatatggaagttctatttttaattttttgagcaacctctacactgttttcattttggctgtaaaaatttatattcacactgacagtgtatgaaagtttcaatttctccatttcctagccaacaacttttattgtgtgtgtatatatgtatgtgtgtgtttgtgtctgtatgttgataaagacatggtaagaggtatgaggtgatatctcattgcagttttgattttcctgatgatgaatttacattaattagttttcatacagctgttgtccatatgtacaacttcctcagagaaatgtctttttcaagtatttgcctatttattaatcatggctttttttctctttttgctattgagttgttgcagttcctaatatattttaggtgttaacctctcatgagatatatgatttgaaactgtttcccattcccattttatcttttcactctgttgacttctttgccctgcagaaactttttagtttgatacaattctactttcatatatttgaccttgttacctgtacttctgaggtcatacccaatagaccattgcccagcccaatgtcataaaactttttccgtgttttattgtgagagttttatagtttcagggcttatgtttaagtctttcatttgttttgtgttgatttttgtatatgacataaactaagggtccaattttattcttttgcatgtggacatctggtgttctcatgcagtaccgtttcttgaagagagtgacatttattgagtatatttgagactcattgaatataagtgcattgtatatttgtgactttatcatctgggctctctattctgttacttaaatctctctctatttatgtctttatgtgaatatcatgttattttaataactgtagcttttaatatattttgaaataaggagatgtgatgccctataactgtgttttacttttcccacattgttttggctagttacttcttcctggatcattatacattttaagatttttttgtctttgtataagtcattggtgtttcgatagagattacatttaatatgttaatcactttaggttgtatagatgtttctgtaacattaaatcttccggtcaatatactatgtctttctaaattagtataatctttaatttcattcatcagtgttttgtagtttttagtatacatgtctttcttccacttgttacagtttattcttatgtattttgtcctttttgaggccattgcaaattggagtgttttgttaatttccttttctgatagttctttgttaatacacagaaaggtaagtgatttttgtatgctgattttatatgctgcaaatttactgaatttatgcacttgttctaataatatttggtggcatctttagggttttccacatataatatcatgtcctctgcaaacagaggttattttactgttgattcagaagcctgttgctttttttctttttcttgcctaattgttccggctaggatttccagtatggtgtataatagaagcagcaagagtgaacatcctttccttattgtgaaaacagatgaaaagttttcagtttttttttaatcattgagtatgatgttagctatgagcttttcatatattgcctttatcaggttaagataatttccttctatttcttgttgcaggaagtcagggaccctgaatggagggactggctggagctgaggcagaacatcataaattgtgaagatttcatggacatttatctgttccaaaaattaatacttttataatttcttatgcctgtctttactgcaatctctgaacataaattgtgaagatttcatggacatttatcacttccctaataatactattataatttcttacgcttgtctttactttaatctcttagtcctgttgtcttcataagttgagaatgtatgtcacctcaggaccactattgtacaaattggttgtagaacatgtgtgtttgaacaatatgacatctgtttgtaaaacatatatgtttgaacaatatgaaatcagtgtaccctgaaaaacaacagaataacagcaattttcagggaacaagggaagataaccataaggtctgactgcctgaggggttgggcagaataagccatatgtttcttcttgcagaaagcctataaatggatgtgcaaggaggagaaataccgctgaattcttttcccagcaaggagtaaccctggggaaggaatgcattcctggggagaggtctatgaatggccactctgggagtgtctgtcttatgcggttgagaaaaggactgaaatatgccctggtctcctgcagtaccctcaggcttactaggattgggaaattccagcctggtaaattctagctagactagttctctgctctcaaaccctgtttcctgttaagatgtttataaaaacaatatgggaacagcaggacatagagcctcatcagtaattctaattctgcctttgccttgtgatctatatggccctttgaagcatgtgatccttgtgacctactccctgtttatacaccccctcctcttttaaaatccctaataaaaacttgctggttttgcagctcagggtcgtctgcacagtcctaccaatatgcgatgtcaaccctggaggcccagctgtaaaatttctctctttttactcttactctttatttctcagaccagtcaccaattagggaaaatagaaaagacctacattgaaatattgggggcttgttcccccgatatcatttctatttctagtttgtttagagctctcttttaaaaactcataaacaattgatttttttcaaatgctttgttttgcatttactgatatatcaagtgatttttatgcatcattgggttaaggtgatatgtcacatttgctcatttttgtgtgttctattatccttaaatctagggataaatttgtcatttcttttaggaaagaagcaatgctgagtcttgaacatagtaaaagccaagcaacactactggtcttgtaatatcaaaaggaagagtgagactttcttcacaatttaattattgagtagtttctttgcaacagtaaaaacaacaaaattctgctgaaaatgaaaccaaagaattctgagtatttgaaaaatggtattaatattgtgaacggatgtcttaatattgggtcaatgtataaagtgtgaaacacagctcagtaatttttgtgcatgtgccacttgtgaatagaataatgtatttcacataaacccatatggttttacattattttttatttttccttgtttttaagtatttgactaagaatatttctaacttttaaataggtactaaatctctggaaaataaattttgacctaacagtgtaagttataaaaatatgttttgtcacaggaggaaggaaatcctctgtatcaacctcttcatgctggaattaactgaaggaattctatcttttggtcattccagcttcaagccttttatgtaactaatcccttttctccttctttcctgttttagcaaactttcagaaagaaaacaggcaacatcttgtgatgatgaagatcacagttgacacataggccagcaggaacctaatcacatgcaagttgtggtattggaaccaggtgaggtcgtgggctgcaacccgaaggtgcttggctcctttgtgctgcatgacaaactcaatccagaaggctgcttgatccaggggcttaattggcaaatcatggcgaattattgataacttcatagcattctctttgtagctgaaggataaacataaaaataccaacattgaaagtaaatttatttcctaagtctatggatggtctttgaaaagtgtcacatcaatgcttcaaagtaaatattatagaattgtcataggaatcgaatgttttggtttggacaaatgtagaaagtttattttttaaaatggaattttataaagaaaaatatgtcttaaattaaaaatggaaggtctgatgagaaagttaatgtctttgtagcagaggaaatattttgagccattctatgtgctacaggtaagacagtggaaatgcaatctgagattgatcatcttgatattttattttatttttttttgagaaagagtctttctctacggcccagattggagtgcagtggcatgattatgggtcacagcagcctccacagtgtgggcttaaacaatcctcccacctctgcctcctgagtagctgggactgcaggcatgcaccactttgcccagtaatttttaaatatttttttgtagagatggagtcctaccagtttgcccaggatggtttcaaactcttgggctcaagtgatccttttgctttagccttccaaatttctgggactacaggtgtgaactacctttatcgacccattttgatatttttaaggaaaaattgtttcacagctggtgtaatatttctaaattagtctttctctttctaccctactattctgtgttctaccatattttcctctcagtagtcagaataattttttgaaataaaagccagattatggcattcctctgataagattttcacctggcttctcactatattaagaataaaatctaaatctgtctttgttctacagaaccctacatggtcaggcatgggcaacttcttctaacactttccccaaccaccttctctcctagaggcattgcccttctattgttctttgagctccccaatgtgttctcacctgagcccctttacaccctttatcccctctctccctctcttggaatattcctccttgcaacaacttgaggcttgcttctatatctttttgaggcttccccttaaataatacctgttaaagaggcttttcgtggccacactatggtagtacctgtaggatttcctctattgttttgtgcttattttgctgtttaactcctggaacttaaaaatatgttacatgtcttctcaaataaaactttaagtataaaatacataaatgtacacaaattcagtgaatagctcaaaattttaacattaccttgaacaatatcctgatgtgaacaccaacttacctactacgcagattataatataagacatcacaacctgcctagaaaaactctgtcttcttgggccattttagtcactacttttgtcctcaagttaaaactaccttgacttctaatagattaatattgcttgtttacataatgaattatataatatatactcatttgtgtctttttttgggtagaagttattggctaattccattgctgtaatatgattcagtcaattgacaaataccacagattatctcctatttttatgactgatggatatttgggttgttaagatttttgaacactattactaattctggggtaagcaaatgtgtgtatatcattagatatacatattaatacatttttgatgggtatatacttgagagatgagttgctgagaaaaagatgcatgtagaattatgatgttttgttgactagctttttaaatacacaaatttaatttccaaaatttagagttgttttttaagttataattttttggataatttcgaatttatttctagtatggctagagcatttcctttttatgcttttgaatcttatcacatttgctaagtcctgatttttggcccagcagaagttcaattcactaactattccatatactcttaataaacgtatattctcaatatacattcacactcacctccacacctccacacataaaaatgtgtgtgtatatatatatatatacacacatatacacaaacttactatatatatacacaatacatatatatgtatacacacacatatatacaataggttatatttatgctcttcaaatgtttatttttaagtcacttttttttctctgtttaaatttagtatgagttctagtagattcacttttaaatctactatcttattctgtattttattttctgttttccaatctgctgtatgtttcttttctaattctttcctgtttgcttttaaactatttttaatcattcactgtcttattatcttcctggtaaggtattttcagtatattttctaagatggtacctccttatatatattgacaatagtaatcaatagtcacagcattttctacattatttcttttggagcacagaaaaattattacagatttattttctcaatattaaaactttgtgcttcaagggacatcttcaataaagtaaaaaaaaagaatcaacctataaagagtgggagaaaatatttaaaaatcatagactgacaaggcattccaccaataatataaaaataattcttatgaatcaataataagataaaaatgttagaaatgttcaaaagataggaataaaattttctcaaaagaagacgaatgacttgccagtaagtgcatgaaaagatggttatgtctttagccacaaggaaaatgcaaattaaatccacaatgaaagatcattttatatccactgggatccctgtaacaaaaagataggagataacaagtgtagggaagagcatgaagaaattggaaccctcctgtacagctagaagtaacgaaaaacggtgcaagtactttgaaaaacagtttagcagttcttcataaacatcaactttccatatggctcagaaattccactcctagtatcttctcaaaattagtgaaaacaacttttttcacaaaaaatatgtatagcagtgtttataagagctaaaattggaaataactgaaatgtctgaaagctgataaatgggtaaattcaaaatggtacattcatcaaagaatattagcaataaaaagaaaaaatgttctgacactttcaacaatatgggtgaaactaataaaagacattgtactaagtcaaagaaatcatttatagaacactgtaaattgtatgatttaatttacatgaaatatccagagagaataatctattgagaaagtaagttgatatttccctaggactggaggtttatcaacagtgattttatgcattttgaggtttattttagggtgataaaaatgttcaaaaattatattatggtgatggctttgtaactatgtaaatgtactaactacttttagatctcacttttaaataggtaaatattatgctatgcaaattgtatcttaaaataatgataatactaaaaatacattattgagcatgaatacagttatactttcagaaattttatgtattgaattgaaatactttattttatttctccaagttcattatttcattgtattataatccatcattcaaaaaacttatattttaaacaattatctatatatgtttaaaaatatttgtgtgtagaaggttgttacagtaattggtgacccattaaatatatgggatcaaatgtaactaaaataattggtgaaaaataaaagcaggtttcaagttggttaaattatttaaattctttcaaaattggtctcctaaaaggggtaagacatgtattcagtgttgtcaaaagaatctgtaaataccacatagtaaaaaaaattgtcatactcacacagggtcattaatgactgtcttcagtgcattgagcaaatctgtacttgacatggtcctgatgtccacattgagggccttcatgtgagcaatgttatcaggttgatctgcaaacaaaggaatgcccaccatagggatcccatggtagattgcctcatagatgccactggtttcaccatgagtcataaaagatttagtttttggatgacctaggattggataaattttagcaaaattattcataagactaaaatgagaaatgcacaatagaatgctctgaaaggggcagtgtctactaaataacagattattatacacatcaaactccattagaattgctttcggatttcagagaaagaagcacctaattcttctggaggtaagtgaaggctacatgaagaggtgggggcgtgtgtgacttcagactcaaaaaatgaattgatattgccaggtggacaaaatgaaaaagcacattctgaatgaaaaaaatgtgcaaaaaaaaagagaaaagaaaatcaataatattgtgtatgttagagcattttcccttaaatacatactgcggtctgagtgggatatgtggtgtatgcaaggcaacagggagtgtggtggtggtattggaatagaagaaaggcaggccacattacatcaggaaacgtgttatcactttatgataaagattgaggatttaggccgggtgcggaggctcatgcctataatcccagcactttgagaggcagaggtgggtggatcacctgaggtcaggagttcgagaccagcctggccaacatggtgaaacctggtctctactaaaaatacaaaaattagagaggcttggtggcaggtgcctgtaatcccagctactcgggaagctgaggcaggagaatcgcttgaacctgggaggtgaaggttgcagtgagccaaggtcatgccaatgcactccagcctggggacaagagtgagacttcatctcaaaaaaaaaaaaagattgaggatttattttcagaaaatgcagagttattggtaataaaagaggcactgttattttttagtgtcttttgaaattaaccctgaagtagggaaaaggacaggtgtaaagctgtacaaataggagacagagagacaatccaggaagttattgggaaaccccgtgagaggtaattatatctgaaataaagataatttgattctgaacataaagaatgtgagtgtctataataaaataccaactatatagttattttcctggtaagactggaaaataaatataaagtagttagcctttatatttgagttttttgataataaatgttccgtaagtttctttcaggttgaactatccttctaattagctgttagtcatatattcagtatttgttctgcagagtattaccaagaaggtcattctgggatatccacttgtacagctgagtattggatgctaaagtatttggtctctttccatccacagaacctgttggggtaaagaaaatatcttgttccatgagtagaatgccaaagctataagatgttagaactctaaagaaattgtcaatcaactagttaaaccccttccatataatagatgaaaaaacgagaacaagcaattttaggaaatgagtactactaaaagactattgaatatccacatttcatgtcttttattatcaatttggtatattagaaaatcatgatgttttcaacagagaagcttagacacttgagagtatcaataaaaaattcaaaaatttaagaaattattagacagtcattataattctactgtaaaatacagtaacaaattagtgacaacctatacatttattttatgtattttatactacctgtaatcttccaaatttaatgttagtttatttcttgagtgaaatgagaagtgttacttatatatatttttctgtaagttattttgttagtgtttgacatctttgatttataaaaaacaaaatctataaaatcagctacctgtgagaaataaatcagtgctacataggtagtacatataacttcttgtagattacacattacccagcactacatccaagaaaaatttcaagtgacaatttctttcttttcttttcttttttcttttctttctttctttttttttttttttgagatggagtcttgctctgttgcccaggctggagtgcagtggcaccatctcagctcactgcaaccctcgcctcctgggttcaagcgatttttctgcctcagcctcccaagtagctgggattacaggcatgcactgccatgcccagctaatttttatattttttagtagagacggggtttcaccatgttggccgggctggtctcgaactcctgacctcaagtgatctgcccacctaggcatcccaaagtgcaagtggcaatttctgagtcaaattcaaagtactatcattttgctagttttggaaattcttccaatgtaggcgaaaagagccaattggcaatttatgaataagaatatacacactaaaaattgtaaaattatattttgctaaattttgcttaactgatcattaacacttagatgctgctataaagcatcgacagcatagattaatatgggctgctttagccaagccatacccatagacagtaccaaaataagatactgattttagattccccaagcaatccttataaactggagtgtaatttacaagtgttttccttgtatttgctatgtgagtgttaaagtaactttgtgtttccagaaaaaaattagcataggtcattaggagaaggctatgtcagagaggaaactaaaaagtaactcacaaatacacaaagacttcaagtgtattctgcatactacaaaataagttcctactatatttcatggagtgagggcatctgaacctctttccatgtctggcttccttctgcttgactccttcttatattcccttctccttcctccgttgggaggaggtgtttttctgatggttagagcagaggctttatgggaccacattttataatgcacggagtctaccctaaaagcaggattctgttccctccttttctatcatattttcctgtttaagacattagcaaggcccagtaaacagggcaggcaagttcttctgcttctctaaatctacttggctaggtggatacctccagaatagcggtttgtcagcctggacatcttttctctgaatgcattctgaattgcctactaaataggtctattccaaaatgtacaggaagtacaggagaccagattacctagcaagcctaaattgaatgatgcatttcagacttttttcaataccttattgttattgtaatagtgcagtaactgattaaaatgtaagtgattttaaataatatctatagtgtataccatgttctcaggaaacttgtaagcaaaagggacaaatgacagggcagaatttggtgatttctatgtacatgcctacaatactatgataataccacaacttcacctgcacctcttaaatatattttttctgatcacaatattaatgtcagaatttttatcaatcaaacacaccctcgttattttagtatcttccatatatatttttgtttttgaaccaatatctgagataattagagctatcatatcagttagtttttctggcagaaaatttctgtgattggactctttacagagtttaacagactcattcagtagctgtccaccattaagacattttatctaacctttcgtggaatctgggcaagagctgatgcaatcacgttggccctttcttctgtgatgttactgaccatagacttaagcaagactgccacgacaccattttctccagagctctgcacaaactcttccattttctgtgaagaatttgttctatcacaaaagagtgtcagcatagcaaacactatagaaaagattagtacatacatctaagaagagaaaatcaagcattatcagaaatttttggagtaatggctattttttaactgacctaatctctttctttggaagaagttatggaatatgatatacatggcatctgttatggctatttgtgtaaatatgtgtgtctgtaaaaggaaaagatgaaaaacaactatgacactatagaagaaggagacaatgctagaaaatattatacccagactcttcatttacaatactgtaattactaatatgggttcttggaaggtggcatttgttgtgtttaattccatatgttgtagttctactaaattccttgtgtctattaaggcagggttttttgtttgtttgtttgtttgttctttctgtagagtatttttagttgggagtcattggaaccattacctggctatgagcagtgaggaaaagttactattgaaataattttatatgtctatttctttagctctgtaattctttatacctcatttaaaacttgtcagattatgtctttttccctaaaaaaaaatctttaaaagctgaagtttaataatgatggagattcaagagtctgatactgtggtgtgaaatttctgtgaactagtcctgagaatcccatttataatacagaattatgcagtatatagttacataactgagtgattgtatttctcaggtcattgtttaaatattactaagacactttttttcctgaaatcacactgcataaaatgatatgctactggccaggcatggtggctcacacctgtaatcctagcactttgggaggtcgagatgggcagatcaccaggtcaagagattgggaccatcctggccaacatggtgaaactctgtctctactaaaaatacaaaaattagctgggcgtggtggcacacacctgtaatcccagatactcgggaggctgcggcaggagaattgcttgaacccgggaggtggaggttgcagtgagccgagattgtgccgctgcactccagcctgggcgacccagcgagactccatctcaaaacaaaacaaaacaaaacaaacaaaccaaacaaacaactgatgtgctacctataactgcctgtgagggaccctcatcatcacttttctgtgtctcacaggggcacttaatcctcagtggaagaatctaccagtcatttttccagtggagatctcttcactatcttgagtagctcattcacacaatataaagcccttgttgaatatgtgtttgcttgaaatttattgagaattactctgaattgtggtttcccttatgttctcatttgtaaatgtaaatgcatagtgtaattccacattgctcagtgcatacgcctatcaagacaaaataaagagaaagagaaatgtagcgccaaaagttttcagtatataatgtcaaaattgaatacccatctttttgttgttgttgtttcttttgttttccatttattatttatttattttctctgtaaaataatgatgaacccattctgacataaccggtatactttcagatcctaaacatgggaggtaaactttcttttaaaaacttgtttaaaaaaagaaatcctaaagtttgtgtatgcacaacatattttgccaagtatttttcaaaaatataatttgagccttatgacattagttttaattggagagtcactgtactactattccaggtagttcttggggctcccaggtattctgtgtgactcgttacctgtgtgaacacaaagtatctgaaacagttctcaatttagaaagtttattttgccaaggataaggacatgctcatgacactgcctcagaaagtctcaatgacacgtgctcaaggtggttggggcacagcttggttttacacattttagcagacatgagacatcaatcaatatgcgtatgacgtacattggtttggtcaggaaaggtggggcaattcaaagtgatgccttcatgtcatagataagagttaaaaggttgcattcttttttgggtcttagatgagccttttgctgaatacacagtatacatatgagagaagggttgagaaatagtcacttatgccttagtctgactcagtaaatctgcattttttccataaacaatggtgaagggatggctttgagttctgtcctcttttgtccctcacctgtgaagataagctatcaatttacatttccagggtgaaattcaacagaaatgtttcaggttaaagattttgaggcccacaaggaatttcctcttgggaagattgtaagggaggtatgtaacttaaaaacaacaacaacaacaacaacaacaaaaacccaactttgtagctattttatttaggaataaaatgggaggcaggtttggctgatacagtttccagcttgacttccctttgacttagtgactttgggttttcaagattatttttctttcagacctgtagccacatttaatggaacttgtgtttgatgttttttctcaatgcctcgctgcccagagtcttcttcatccacccaatattgaggtagcatattgtctgtttatacactcatcagtgatctcattctgggatatcttcatgaaaataatatatcagtgtacaaaatattagagtatgaaaagcttaaaaaaattaaatttccctcatactctctgtctagagctattcctgatttaaatttgtatgcttttattatggtttttattctatttatataattcactgtgatgtttatttagataattttaatcttattgtatattccttttcatcctgcataaaaattgtgatctagttctattcatcattttgtttctcagtttccgacaattcttgtattatagctgacactgtaattatacatattttgataaaatgattgtaatggcatagaatgcatattgtatacatttttacatagtacccaatagtttttcaggccttctgcccttctcttccctctgtagtagtccccactgtctattgttcccatttttgtctatgtgtgccccaagcttagctcccacttttaagtgagaacacatagtatttagttttctgtttctgggttaattattctggttcatgtgtgtgtgtgtgtgcacaaatctccatgtatttgtttgtttatcttggctttaatctgtcattttattttcttttttcaaatgttgtctgcctatctatctatatatttatctatctaatctatctatctatctatctattatctatttatcatctatctatatatttaagaatgaggacatagaatgattcactgggatatctttgtatctgtgaaggacttagtatctggttggctttgatttttatgctgaacgcgtacaactactagaccttacctaaagggaaccaaaaatttcataaaaaagattatactttgatgtgttacatcaattctagttttctcattttaccctggtgaatttatttcaatttctttaaggaaaaactctctagtttttgtgtggaaagtgcaaagaggaacgtattatgtaatacagtaagggttagtgcatttcattttcatgtctttagtttcctttagtctgtaattatcccttcattttttgtctctgttaatttttgacttctagatgaattattgaccagttgttttgtagaatgattcttattttacatttgtttaatgttccttcatgattaagttgctatcacacattttttgaaagaatactgcagacatgttgttgtagtcttcacattacatcatttttgggcagcagatagtgttgatttgtcatgctggtgatactaactttgatttcttggttaagatgctgtctacaggtttattccctgtaaaattataatttctcattttggaattagaagtatcttgataggagactttgagactgtaaatatcctgtttccattacatcctttccctctaattttagcatccattcaaagataatttttgcctgaattaaattactgtggagtttgtctaatgattatttctatgtctataatttctttaacaattagtaagagaaattctactctaagaaagaacattttttcccttttatttccttatactggtttctgtcaatatgatttcatgagtatttggtttattccaaaggttacaatccacagctatcattattccattgctcaaattggtccagattcgattcattgggacttccttcagtttccttctatatttttctgatatgttgtcatcatgttgtatacttatttactttctggcacccctagatatttcaggcacatcctgtacttttgttgcctcaggggtaatgtcatttatatcttgaggaaggcatggttcgttttattggagtatagtgtctagaagcaaaatttcaagtacttagcatgttcattgcatctgggatattattacttctaggccatttacgcatagacattttggaaatgtatctatgcataacttttcattaacagcttaagagaataaataaattatcatttccataaaatacagaaaaaggagagtgtagtaagctaaaacatggtaaatctaaatagtaaatatttacagataagctcaaactaataatttaatgtaaaaagttattttcatttaatgtcatgtaatagttatatatcaatttaaaaaagaattaaataaactcacccattatggtagagattctcagatatttcaatctagcttttatttttgtttaaaagagaaacacctaataaaaattacccatattactataaaatatatacagattttacaagaggcatatacccaatagcaaataaatgaaaattgatgcaatgctacaaaaatcaaacaaagcagaattaagatgcgaagtatcaaatgtgataagtgaatcatttcatgtggatagaaataattcacttaaaattaacaataataagtatttggagattgaaatatatctcagaaactgatagattgaacagagaaaataaattctatgaaagttgattgtattagcaacaaaagtaacaaaaataacgtactgaatcctgcatcttcaaatagagtataaatattcttttgaagtgcacatgaaaacttttataaaattaaactaaggcaatgtcacagatgaaatctccacaaattctgaagtatatatatcatatgtatctatataatgtgatacaattaaaataattataaacttaaagagaatgtattacctttcaaatatacacatttaagaatttcattcagtggagtggactgtgcttaccattcatgacccaagtctttactaccttttctgctccaaacacatataccatgaagagaagacggcatagaatatactcaggtaagtatacaactgagaaaacttacacaccagttgttagcattagagaaaattatatgaatagattcttataggagctataacaagatggttttggcaggataaaaaatgtggcaaaagccttaaaagtggaaaacaaaatttacctacggagttcagggaatttctgttctgaaaaaatgtaagttgtaataactaaaaaattaaaacaaattataatgaaactgatctctctagatgacagcagacacatgcaggaaatgaaagtttgcagaaattaacagctgttgaagattaactcatgaaaaccacatgaggaaataaccaattctacacaatagtaagattttcacccaaagtttataaatataggaaaaaatcaaaataattttttttctcagagatgagaaaatacttaacataaaaatggaattgggtgagaagcatgaatagaaagaggaacatttagaaattgtggaaattagaaatacagtcactgattgtataaaatgtaatagagttcacaaaataaaatggaaccgaatgaacgaataaaagaatgaacaaaacctgcaataaggtgaattagtaaactttctctttttctgactgaaccttgactgatagagcttccaacagaaatcacctaatactgtaggaattgccattaagctgattaaaatatgaaagtgttatttgctattaccacatgttagagccctcctgattgcctgctttacttctgaagctctgtcattatggtttcctggttttaatcactcattctatgcttcactgaaatattttgaactgattcaatgtgtttctctcaaatttaattttattctatcctgtctcttgcctcctgcaggttctcactgtgagcaatccagctccagagcttaccttctctgacctagggttcctcatttttttttttttaccagtttatctgaacttcattgatcttgttcctttgccaatcactctgagccactgtcatcatgactcaggattctagaatttgaacaaattataaatttgccctttgtatcttctgtatcccaaagaagaaccagtagacggtaccacaagagaaaaatgagtgcagtacatgaacaaaacacctgaatgaatcacaaacaaaaagagatggttgattagatttataattaagcatttgccaatcaaatcagtgattcatttttatattatttggattggtaaaatttaacatccaccatagatgaagcacgaaataactgtccactccagtgctgcataggtgggtgtacatagagggaggtagtgtttgaaggatacccctgggctcaactgactcaagctagctcagtcttggtaagagggagactggacacttctggtacagttgggctgcagacacactgtaccaactgtaagttcactttggtgagaatcttcatatgccctcacttgaaagaattttcttttccagataagtttatgccttttattcatccgaattttaccatgatgctgtgctcaaagatacaacaacatttgaggcactaaaaaatgaaaaattttaaatattgttgtctgctctaacagttttcaatttactgaaggtggaaattttacagttattaagaaataaagtaaactgaaaaaacataggtggagtgagactgagagaaaaagaaatggagagagtcatggaactcttcccagcagggtgaaaattattggatatttattaagaaaagggatgaatgaaatgaaaattaacatggctaaaaaaaggtctcaacacaacattatgagaggtaaggtggtcaaatgagactttttgaaattaatccaacctaaaagggccccaaactaatcagtttcatttatcgcagtgtggagtagtttaaaaagcaggaatgcagagatcacagttagaaagctgcttaataatttcttcagataatgctgaggcagattaatcaagataaaaattaacacacaaaaaaagggtttattggtttaaggccctgctgttgacccaaagccttgtgtaagactgtcaggggatagggaacagaaattccagagactccttaatacaagaccccatgtgatatgctaccaagatgcattggggaagccttgaccgaggttatagttaggttgagaaaccataaaaatataaagattaatagaattatgaaatttgtgatatttaaacaggcttaatttaaagaaagtgtgtctttttaacttaaatgtcttatgaaatggactttatgtctggctggaaacacttgttctgcctattgataatattgtaacacaaaacctgctgataaagtcctaaaggagcttaagtaaaggttaatgaaatgaaaaggaaaatgtataggaaagttggtatttttgaacatactttatgtgaagtagtatctattttatctgaatgtgtcaaggttgaaggacactgtatctaactaggaaatgtttcttgaatctaatattgtataacagaaggtatgcaaatttgcccttcagccaacattaattggacatgctaaatgaaaaccactatggtagggtggagtcaagatggccgaataggaatagctccagtctacagctcccagcatgagcgacacagaagacgaatgatttctgcatttccaactgaggtaccaggtgtatctcgctgaggattgttggacagtgggtgcaggacagtgggtgcagtgcactgagcatgagccaaagcagggcgaggcatctcctcatctgggaagtgcaaggggtcagggaattccttttactaaccaaggaaagggtgacagatggcacctggaaaatctggtcacttccaccctaatactgtgcttttccgatggtcttagcaaatggcacaccaggaggttatatcccacacctggctcagaaggtcctacacccacggagtctcgctcattgctagcaaagcagtctgagatcaaactgcaaggtggcagcgaggctgggggaggggctcccacaattgccttttgtttggctatgccctgaccccagaggtggactctacagaggcaggcaggcctccttgagctgtggtgggctccacccagttcgaacttcccagccactttgtttactcaaaaccgctcaactatatggaaactgaacaacctgctcctgaatgactactgggtacataacaaagtgaaggcagaaataaagatgttctttgaaaccaatgagaacaaagacacaacataccagaatctctgggacacattcaaagcagtgtgtagagggaaatttgtagcactatataccctcaaaagaaagcaggaaagatctaaaactgacaacctaacatcataattaaaagaactagagaagcaagagcaaacacattcaaaagctagcagaaggcaaaaataactaagatcagaatggagctgaaggagatagagacacaaaaaacccttcaaaaaatcaatgaatccaggaactggttttatgaaagaatcaacaaaattaggagactgctagcaagactaataaagaagaaaagggagaagaatcaaatagatacaataaaaaatgataaaggggatatcaccaccgatcccacagaaatacaaactgccatcagagaatactataaacacctctatgcaaataaactagaaaatctggaagaaatagataaattcctcgacacaaacactctcccaagactaaaccaggaagaagttgaatgtcttaataggccaataagaggctctgaaattgaggcaataattaatagcttaccaaccaaaaaaagtccaggatcagacggattcacagcaaggacttcatgtctaaaacaccaaaagcaatggcaacaaaagccaaaattgacaaatgggatcttattaaactaaagagcttctgcacagcaaaagaaactaccgtcggagtgaacaggcaacctacagaatgggagaaaatttttgcattctacttatctgacaaagggctaatatccagaatctacaatgaactcaaacaaatttacaagaaaaaaacaaccccatcaaaaagtgggcgaaggatatgaacagacacttctcaaaagaagacatttatgcagccaacagacacatgaaaaaatgctcatcatcactggccatcagagaaatgcaaatcaaaaccacaatgagataccatctcacaccagttagaatggcaatcattaaaaattcaggaaacaacaggtgctgaagagggtgtggagaaataggaacacttttacactgttggtgggactgtaaactagttcaaccattgtggaagtcagtgtggtgattcctcagggttctagaactaggaataccatttgacccagccatcccattactgggtatatacccaaagaactttgaaacatgctgctataaagacacatgcacatgtctgtttatagtggcactattcacaatagcaaagacttggaaccaacccaaatgtccaataatgatagattggattaagaaaatgtgtcacatatacaccatggaatactatgcagccataaaaaatgatgagttcctgtcctttgtagggacatggatgaagctggaaaccatcattctcagcaagctatcacaaggaaaaaaaaccaaacaccgcatgttctcactcataggtgggaatagaacaatgagaacacatggacacaggaaggggaacatcacacactggggcctgttgtggggtgggggcagtggggagggatagcattaggagatatacctaatgttaaatgatgagttaatgggtgcagcacactaacatgacacatgtatacatatgtaacaaacctgcacattgtgtacatgtaccctaaaacttcaagaataaaaaaaaaagagtttttcaggatgatggtccatcctgaagtacataggaaaaaaaaaaaaaaggaaaccactatggtattccaagttcatacaatgtagaatagaagctggagtgttagtacagaaagcattatctgttcgatagcccggataaacaacttcaggaaagtttcaggatgcaaaatcaatgtgcaagaatcactagcagtcctatataccaacaaaatccaagtcaagagccaaatcaggaacacaatcccattcacaactgccacaaaaaataaaataaaatgtctagaaatacagtttaccagggatgtaaaatatctttacaaggatcactacaaaccactgctcaagaaatcagagatgatacaaacaaatggaaaaaaaatccatgctcatgggtaggaagaatcagtatcattaaaatggttatactgcccaaagcaatttgtagatttcatgctattcttatcaaactgtcaatgacatttttcaaagaattagaaaaatgtattttaaaattcatatggaaccaaaaataaaaagcccaaatagccaaggcaattgtaagcaaaaagaatgaagctggaggtatcatattacctgatttcaaactatgctacagggccacagtaaccaaaacagcatgatactagtataaaaacagatacgtggatcaatgggacagaatagagaactcagaaataaggtcgcatacctacaactgtctgatctttaacaaagctgacaaaaaaaatggggaaaggacaccctatttaataaatggtgttgggataactggctagccctacgcagaagattgaaactggaccccttccttacacaatatacaaaaattaactcaagatggactaaagacttaaatgtaaaactcaacactataaaaaccgtggaagacaacctaggcaataccattttgtgcataggaacttgtaaagatttcatgataaaaacaccaaaagcaactgcaacaaaagaaaataaaaatgacaaacagtatctaagtaaacttaagagtttctgcatagcaaaataaaatattaacagagtaaacaaacatactaaagaatgggagaaaatttttgcaaactatgcatctgacaaaggtctaatatctagcatctacaaggaactaaaacacattttcaagaaaaaaaacattaaaaagtgagcaaaggtcatgaacagacacttttcaaaggaagtcatacatgcaaccaacaatcacatgaaaaaaagctcaacataactgatcattagatgtagatgatgggttgatgggtgcagcaaaccatcacagcacgtatatacctacgtaacaaaccggcatgttcttcacatgtgtcccagaacttgaagtataataaaaaagttaattaattaaaaaaagaaaaatgtaaatcaaaaccacaatgagataccatctcacaccagagtggctgttcttaaaaagtcaaaaaattaccgatgttgatgaagtcgtggaggaaaggaaacacttgtacactctaagagtgtaaattagttcaatcaagaccagactaaatatagatatgcatccagaaatgcttttagaaaatatatcatatgtttataatacataagctaataaaatgggagagttctctgattcccctggcaggatgtgtgacaggggtgtggctcacctgtttggtcacccggcagctcaaacccctaaggcagatgggcaggtgcagaggccaggcaggtgcagaggccagggcagagcgttttggactctcagccccatggcagcgtctagggctgggtgcctacaaccacagtgttactaagctctgtcagctttgccatctgcaggcggcttgtgtgttagttagcccaataaaccctctgccttatctcaagggcagaaggccagtgtgacagtcttatgtatcctgagttcttgcccagtgtcccaaaagaatcggatcacacgtgagcgtgaaggattgaatgcaaggttttgttgttgttgttgttgttgttgttttctttcgttttgtttttgttttttagagacggagcctcactctgtagcccaagctggagtgcagtggcgccgtcttggctcactgcaaccttcacctctggggctcaagagtgaatgcaaggttttattgagtggtgcaggtggctctcagcgagatggataggtagcagaaggagggatagactgggaaggtggtcttcccctgcagtcgggctgcccagaggcaggactctgctctgaccgccgccagctccccaccaccccacctctccgctgaactatcctaagcatctagagaggtccctcctcttctctatttctctgccacatcgttctgccgttgctagtctgcttgtcggctggtcgtctggccttgatgttcagctgcttgtgtgtgtgcctgctaaggtctcaggtttatgtgggcacagaatggggggcgtggtaagccagagaggtcttggaaaatgcaacattcaggctcaaaaacaggagtgcctgttctcaattaggtctgtgggcacatgcccgagggtgaatccctcaccagtgaccttgctcttctctaccccacacttcgctgcccaatctccagttccactaatatatctaaaagtcacatgggatccctccagtctagattattggtgagactactgaaagcttcaggtacaactttaacatctgcttaccttgtttttttttctcttaaacagctttagtaatgtataattgatgtactataaattctacctatttaaagtgtacagttgataagttttgacatgtaaacattcatgaaaccattactacaatcaagataataatagatcaattgccgcaacagttttatcatgttcctttgtaattgtcttatacttctccccagtctcctatagccaggtaaccattcatctgttttctgttaatagagctttgcttgcatgttatagagtttcatataaatggaaccacagtctgtatacttgtttcactagcatctttcactcagcatcattatttttattttgagatttatttactcttcatgtaccaatggttcattccttcatagtgcggagaaatacctcattgtatagatatgctacaatttttttattcattctctgttgatggacatttaaattgtttccaatttgaggtcattgcaaataaaattacgatgaacatttgtgtaaaatctttaaatggatatgtgttttcatttctcttggctaaatacctagaagtaaattggctagatcacagggtaagtggatgtttaactttttaggaaactatcaaactgttttccaaactgattttaccattttatttccaccagcagcgatggagagttctggttgctttatattcttgccaacatttgatatgacctgtctctttaatttcagcctttctaatatgtgcatagtacttcattctggttttagattgcctttccctaataactaataataataagcatcttttcatgtatttactgaccatctgtatcttctttggtgacatgtcttatccaacattttaattactttgttttattatttatcgagttttaagagttatttatatgtgttctatgtatcttttagcagatatatgttttgtaaaatattttttatttcaatagctttcggggtacaagtggtttttggttatatgtattaattgtatattagttaattctgagattttattgcaaccatcacccaagtagtgcatgttgaacccaataggtagtatttatcccacaccccattcctaccctctcctttctgagtctctaaagcccattatattactttatatacctttccgtactcacagcttagctctcacttacaagcgagaacatacgttgtttggctttccattcctgagtgatttcacttggaataatggcctccagctccatttaagttgccgcaaaagacattattttgttccttctcatggctgagtagtatttaatgatttatatatacacctcattttatttatctactctttggtcagtgtagacttaggttagttccatatctttacaattgttaattggattgcaataaacatatgtgtgcatgttttttttttcttcatataatgactctttttttggtggggggatagatacacagtaatggcattgctgtattgaatggtagatctacttttcatttctttttttttgagatggagttttgttcttattgcccaggctgaggtgcagtggcgtgatctcggatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctgaagttgttctgcttacttttgagtaatatcggtagctgacattttctgagtactgactgtgcccaatctgctctgtgtgctgcctatattttacctcacttaattcttatcacagtcttataagggatttttttttttttttttgagacagagtatgccctatgtggcccaggctggagtgcagtggtgcgatcttggctcactgcaacctctgtttcctgggttcaagcaattctccttcctcagcctcccgagtagctaggactataggcaagcaccaccatgcctggctaatttttgtatttttagtaaagatgggtttttgccatgttggccaggctggtctcgaactcctgacctcaagtgatctgcccacctcagcctcccaaagtgctggaattacaggcatgagccacagcgcctgacttgttatctttattaggaacaaagtttcttctgagtaaacatttagtctttttgttgttgttgttgttgttgttgttgagacagggtctcgctctgttgtctaggctggagtgcagtggcatgatatcggctcactacaatctcctcctcctgggttcaagcattcttctgcctcatcctcccaagtagctgagattacaggtgcgcggcaccatgcctggctaattttttgttgttttagtagagatggggtttcactatgttggccaggctggtctcaaactcctggccttaagtgatccgcctacctcggcctcccaaggtggtgggattacagttgtgagccatcacgccggcttcttggtggcatcttgatacagggtgtgctggatatctgtggccaccctgatcaattttccaccttgctctattccttaagaatctcattcatagggactacacaataatcgtttatcttctctcagttttggttgagttcaggcatttgaagataggaagaaagtaagggttttgaactatttattttcatggctccctctatgtagggttaacatagggtagctctgtctctctatctatgacctcaattccttttcaaccctatctatacatctattctatctgggctctagtaactctgccttccacttgcccatccaggcccagggtagtgctatggaatgaactcccatccacccccaaattcatatgttgaagccctattccccaatatgactatattcgaaaataagaccttaaggaggttattaaacttaaatgagttcataagggtgtggtcctgatccagttgggttaatgtacttattaaaagagacaccagagagcttgctttctcttctcattcaggcaccaaggaagggccatgtgaggacaaagcagctgtctgtaagccaggaagggagccctcaccagatattgtaccctgttagaacgaaccttgatcttggactgtccagtctctaaaactgtaagaaaattaacttctgttgtttaagccatccagtctgtggtattttgttatggaagcccaggctgactaattgggatagtaaggcactatcttgtatagtttcttaacactctgcccgcacttttgtaaagagtccctttattaaactccccctaattggcattcatgctgttttctgataggatcctgattcatacaaagcagacaatcagagaacattacccaagctaagaagagtgactgacccaaatgttctccttctctcctggaacttgaaggcataataagagtgcatcttatttctcttggtagttaggcttcagtttctgtttctgttttgaagtgtatgagactgctgtaactcatgctctgttcttttggcccagccaatgtatggcagtttcttataaggatcacaacccaccatctcctcaggctgaccagattcttcacttcagctcttgctggtactgtggatttttcaagactcacttatgtgcatactccatttgaccctagcactggcctttgcagtggtgactccttggagaaaaactcactcagtccatggttaacttgcacacacctccagagttacatgggcatttctagttctcttcacatcttgggaaaccaagagacaatctcctaggctccccctgcttaaacatgctacttaaccattttaactctactgtggccttcacattggctctaggcactctgcttccaaaattccaaacaggaagtggggtgcaaatcctatgtactttcacttaatgtctctgtagacattcagaagcacatttccacccaatttccctctgaccctcttcttggacaaagtttttgtgataccactttgatgataaagaatctagtgaggccttaagatacaacctaagaaagaaggtcaaaaactgcaaagtagaaagaacatttagatttctacaacttttgcaatttcttgtgtatgtgacgtttgtctccttataccacagagattaccaaaacaggcaccagaggaaaaaaaagatgatcaccaccaccaccaccaccatttaataaataatgtgtttagcataacttcaggatgagaaaagaagattagagctggtgggacagtgattctaagacttctcagaggtgatttccaggatgactactccaaagagaagaggcaagtaaactgcagtcctcaggacctgttgctaagaagaaaagaaattctgaagaatcaattcagatctgaaaatattggactgggtcgaaacacacttgaaaatataatctgtcatacattttctcattgcttaggagtatgggcttgggcataaataagattagcattttagcaaacatttactgcttagaagctatgtgaacgtggagaagtgtaacacagaggtgaagagccctggctccagagttagggatgtggcttgaatcctcgctctgctacccagagcaaattatttacttctttgagcaaattatttacttctttgaacctcattttgttttctttaactaggatagctaatccaatagttttttcttcatcaagtcatatgtgaagtacttatcactaacctgttgtgtgtatgcatgttagtgctaagtacttcagcaattgatcatcattattatcaacctgagaaaactcactttattcttgtcaaaggaaaataaatctcaggacccaaaaatcactaagccaaagggaagtcaagctgggaactgcaatgggcacacctgcctcccattctattcctaaataagatagctacaaaaattaaaaagctacatgcttcccttgcagttttcccataaggaaattccttgtgaacaagagacagaactcagagtcatccctgtgctcacgtgagtcagagtccagcctgggcagcatagtgaggccctgtctcgacaaaaatttaaaaacttagctgagtgtgattgtgtggttggctcatgcctgtagttccaattacttgggaggctgaggtgggaggattgcttgagccaggttgctcaatgctgcagtgaggtatgacactgccactgcatgtcagcctggaagacagagtcagatcctatctctggaaaaaaaaaatgcttgtagaatgtaaacatgaggccctgtctctacaaaaagttgcttgggtgtggttgagcccaggagtttgaggttgcagtgagcaatgattgcaccattgcattccagcctggataacagagtaagatactgtttgaaacaggaaaaagaaacaaaaacaacatttgtatgtgggtatgttttatttccggggggctgctataacaaagtattatagattgtgtcttcatattttggaaggggaaaacaagctcattggggccgcttttttaagggcactaatcccatttatgagggctcttctgtcacgatccaatcaccatccaaaggcccaacctcttaataccaacaccttggggcttagaatttcaacaaacggattttggaggcaggggacataaatgttctgatagcagggctttttagaagtgtcatgaataattaaattctaatcatggtagccaagccatgtatcagctttcttataacttaattagaatgccaaatactgtggaagaaacaataacattgcaagcaaatgtgttattgttactttgaaggaagttatcttctagtatagtagaagtagtagatattgtagtggggtaaaacgtgttttctgacaatgactccttttaccagtagtgaactggtaaatgtttaacaaccagctctccagaaaaacaaaataaaacaaaacttatttgtaatgtttgtcaatttatgtggtgtaattactcctaccatgaccaatttcaaactatctatgtgacatctcatcactgaacacaggaagaaatgagaagtaacaaaattttatagtattttcaccatacaggtgcaataattgtaaatataaataacctcaagaacaaataatattaagttataattgaaagaatcaggaagtggtgaattttgaatatttattacttttgtatttaatatagtttacttaactatacttaatattattaactttgtataatttattttttaataatccctatgtttaacaaccagtctacaaaaattttaaaaatttaacaactggctcttataagtcattacaggcaagcttcagcacaccattatgcttaactgcccctcagatacacagcactcatagctatatatgtatgattttataggatatcctggccacagctgatgagagtaaatagggatgggaataggttcaatgtcacttctcccagaatttggaaagggaatcagactggaaatcatcctgtttgtgtggctgaaactataactcatgaaaatttgaagttacaggcagtcactttttgaccattatgtggacttagtagtaaataagatttatcttccagtatagaagcataaaaatatgcaaagggaaaccagaaatggggaaacacatctcatttgtcttaaagcattctagatttcagcggcagttcttgagacctggttgcattctacccttcgatttggacagatacatttaccctcacagtagttttccttttcctctaatataactcgaattgctttttgttatttgcaaacaaaaagatggacatgaaggaaaaaggaaatagcaaaatacgcaaaataataagcgtagtataatactgggtgaaaaatgttcaattgctctatagctcatagatcaaaatagagaactttgccctaactctattcgtagataatgaacattaggataaatatttcaactctcctttttgagaaaaccacaatctaaatacagctacctttctctgtagattctactgtaatgtgtgcttggatttaactgcctctcattgtaaacaagattgttttgaggcagctgaaaggtaaagagctttcctttggcaagctcaacaactcttgtgacttaatcatcatctatacaagaatgattacttcagtcagacttctcacctgatgtcagttgtttccttgacatcttttcttagatgtctcatgattagctcaattttaaaaagctcaacagtacccccttgatccaccactacccacactgtccactaacctactcatgctagggatctgggaattagccttctcctcacctcacatctccagcacttgcagtacagtgaggaagtgagggtgaaggggaaagggagctaaggtacagacaatggctaatttacatctcttggtggcaagtgttacaacaggaatagtatacaacactatagagacatacaatgggaataaatccatgagttagtcatatgctcctttctagaccgttctctgggtactcactgcctgaaaaacatgattttttcttacaggtttcagctaattctgcatctcaccaagaaatttttccttgacaacctctccctaacagaattagttgtctctgttgtgttcctgtaaccgagtatccccatttttcttaagaaaaagggaatgaataactattattattttctcttctctttttccttttccccttgatatggtttggctctgtgtccccacccaaatctcatctgaaattgtaatccttccccatgtgtcaaggaagggacctggccatggggcgataggatcatgggggcagtttccctcatggtgttctcaaaagatctgagttctcaaaagtgagaagtgagttctcaaaagatctgacagtttaaaggtgtgtggcagttcccccttcattctctcctgtcaccttgtgagaaggtgcttgcctctccttcaccctttaccatgattataagtttcctgaggcctcctcagccatgtggaactgtgaagcaattaaaccttttttaaataaatgagccagtctcgagtagttcttcatagcagtttaacaatggactaatacagagaattggtactggagtttgaggcactgctataaagatacttgaaaatgcagaagtgactttggaactggataatgggcagaggttggaacagtctggcgtgctcagaagaagacagaaagacatgggaacaagtttggaacttcttagagtctagttgagtgattttgaccaaaatgctgatattgatatggacaatgaagttcaggctgagatggtctcagatggagataaggaacttattgggaactggagtaaaggtcactcttgatatgctttactccagagactggcagcattttgcccctgccctggagatctgtggaactttgaacttgagagagatgatttaggttatctggaagaataaatttcctttttttttgagacagagtctcgctctgtcacccaggctggagtgcagtggcatgatctcggctcactgcaagctccgcctcccaggttcacaccattctcctgcctcagcctcccaagtagctgagactacaggcacccaccaccacacccagctacttttctgtatttgtttagtagagacggggtttcaccatgttggccaggatggtctcaatctcctgacctcgtgatctgcctgcctcagcctctgaaagtgctgggattactggcatgagccaccatgctcagcctataaatttctaagaagcaaagcattcaaagtgggatctggctttttctaaaagcctgcagtcatatgcattcacaaagagatgatctgaaattggaacttaggtttaaaagagaagtagagtgtaaaggtttggaaaagttgcagcctgaccatgtggtggaaaaggaaaacctgtttttgggggagaaattcaagtcagctgcagaaatctgcaaaagtaaagagaagccaaatgttaatagccaagacaatggggaaaacctctccagggtgtttcaaagttcttcacagcagtccctcccatcacagactcagaggccaaggaggaaaaaatggtttcgtgggccaggcccagggcccccctgctttgtacagctttgggacacggttccctgtgtcccagctgctccagtgccagccatggccaatggaggacaaggtacagcttagttcattgcttcagagggtgcaatccccaagccttgatggcttccacatggtgttaagcctgcaggtgtgcagaagacaagagttgagctttgggaacctccaactagatttcagaggatgtatggaaacgcctggatgtccagggagaagtcagctgcaggggcagagccctcatgcagagctcatactagggcaatgcagaggagaactgtggggtggagcccccacacagaacctccactggggcaccacctcatgcagctgtgagaagaggactactgtcctccagattcccaaatggaagattcactgacagcttgcactgtgtgcctagaaaaactgcaggcactcaatgtcaggacttaatgccacccaatgaaagcagctgcagtggctgtaccctgcccagagccacaagggcagagctgcctaaggtcttgggagcccaccccttgcatcagcatgacctggacgtgaggcatggagtcaaaagagattattttggagctctaacacttaatgactgccctattgagtttctgatttgcacgggggcctgtagcccctttgttttggccaatttttcccgtttgaaatgggaccatttacccaatacctgtaaccccatcatacactggaagttattaacttgcttttgattttacaggctcataagcagaacggacttgccttgtctcagttgagattttggacctggacttttgggttaatgctagaatgagttaagactttggggtactgttggaaaggcatgattgtgttttgaaatgtgagaaggatatgagctttgggcggggctgggatggaatgatgtgatttggctttgcatcccaacccaactctcatcttgaattgtaatccctgcatgtcaagggagggacctggtgggaggtgattggatcataggggcagtttcccccattctgttctcatgatagtgactgagttctcaccagatctgatggtttaaaagtgtgtggcagttcccccttcatgctctctctcccgctaccttgtgaagaaggtgcttgcttctctttcaccttccaccatgattgtaagtttcctcagtcttccccagccatgcagaactgtgaatcagttaaacctttttttttaaaataagttacccagtctcaggtagttctttatagcagtgtgaaaatggactgatacacccctgttctccactttctacttagtcttttagtaatgacaatatagccttttaccatccccttcaccagacgctccctacagggtaagttcatctatgcactctaagacggaactctctttgagagttaacagtcgatttatagaccaaagcatgcctgctatggaactctcacccaccagagggttacctcaagagataacaattgaaaaacatgtccgctactgtctcccagctagggagtttttatcatagtcctgcccacaaaaatgccagaagtcaccagcttgacctcctggtatgtaagggaccaagctaacatgcagacccctcaccttgctcacttcctctcctgccttttaaaagtgcctgctttaggttctcactcataagtaggagttgaagaatgaaaacacatggacacagggaggggaacaacacacaccatggcctgttgggaagttggggatgaggggaaggaacttagaggatgggtccgtaggtgcagcaaaccaccatggcacacatatacctatgtagcaaacctgcacgttctgtacatgtatcccagaacttaaagtaaaataaaaaaataaaaaaataaaaagaaaaaagaaaatgaaaaaacaaaaaaaggaaaaagaaagtaagtgcctgcttttgctccagaaacaaagtagtacatttaaagtcaagactcctgtgcttcttcccctaagctagcttgggaaataaatcactttgtttataccagacctcgcttttgttaattgggctctgcaagcattgagtgactaacctgcatttattagttacattctcactgcatttgtacttgtctccattacaacaattataattatagatacattttaagttactatggagccccagcagaatgcctgtcacatcaaaattatcaaagaagtatttagtaaagagaagaaaaaaaagaataaacagaagatatcaacagctctggattctaccagtgaccagcattcaatcaactctatataaattattctctctgttcctatattttctcctttgtccagtaagaaattggactcatggccagatgcagtggctcatgcctgtaatcccagcactttgggaggctcagtggggtggatcacttgagcccaggtgttctgagaccagcctgggcaaaatggggaaaccccattgtgggggttcagtcaggctggtgggaaaaattttagttatcatagccacaaaccctcttggaaggcctgagagtttgcataacttcagtaatagatctagctgaaggcagcctagtccctttacctttagttaaataggttaaagtagatacaaaggaatgtgggggagtttatctaactagcttgtttactcatgtggtcctaagactaatcttagtgtgcttaattgctttctactcgggaggtccgcaatgtcaattaccctctagtggtgttgactcaagcctttgtcaattaatctttactgaatgaatgtgagtcttgctgtgtctaggctggaggttccaactatttacagcactcttcttggtgtctgtaagtggcctggatgctcagccagactggcaaagcagaatatctgtgtcagtgcacgttattcatctgtcattgggtcagggtctgcaggacagacccctgcaccccatctctacaaaaaacaccccctgcaaaattgtctgggcatggtgccacatgcctgtagtcccagctacttgggagactgaagcgggaggattccctgagtccaggaggtggaggctgatataagccaggatcatatcattgcacttcagcctaggcaatagaatgagaccctgtctaaaaagaattaaaaaaaaaaaaaaaggaaagaaaggaaaaaaagaaaaacgatatggagcttgaactttccttgactttgggcacgtcacatggcttcgatttcttcatctataaaatgtcaaccacagagttattgtgaagatcaaatgagctgtgcatgtgaaatgaaactacctttacaagcattaaatgctataaaaattttaagcatggcttttagtagttttagctctaattttctattattctaaatagtggaatgtggtagaagtatatcactgttttttctttttttctttttaaccagtggtggggataaggggaaggaagtggttgaaaaatcgaaagggaacttcttacttgggtaagtctggacttaattgtgccaaactttctaaagcagcttccaggacaaatttccaggaatatttaaaaaattgtttagactgactggaacacagatatgaagccacattttttgtgcacgtgtgactatgtgtgcctctggaagatttcaacacaaacacgctctcatctaaattaacgctttcctctgaattgactcatttgaccagcataaccagtttgcatgccagtgcaagcagagaaagttgtaataaaaagaagaaaagaatgaaaggcatttagaaattcggtggttaaatgtacacttagttaatcattgtatttgtttttcaagggcttcctaaccttttggagaaagaaaaatatggcagaaagctgactgaagtttgaaattaatatgtgcaaaatgtctgtagaggatctagtctatcctcctttccttcatcttaagacttaattttatccaaaaattaagtagcctgattagtcatccttgctttcttctcttcctggctccttgggttttttcccatatgtatttgttcagcatctattacaaagcaggcactgcccaaggcattgtttttaatgtacaagtagggagtttgaaattcatcctttcgatcagaagttctcaaactatacggtgtatatgattcacaaggaaaatttgtccaaaatgcagatttctagtcttaatcccagatatcagatttgaggctcttcgtggggcctggcaatctgccattttaacaagtgtctgggagagctgtggctcatgcctattatgccagcactttggaaggacgatgcaagaggattgattggaatttgtgaccagcctaggcaacactgcatgactctgtctccacaaaaatttaaaaaattagccaggtgtggtgttgcatgactgtagtcccagctatttgggaggctgaggtgggaggatggagtgagctgtgatcgtgccactgcactccagcctgcgagacagaggtgagaccttgcctcaagagacaacaacagggccaaacgcggtggctcacgcctgcaatcccagcactttgggaggctgaggcaggcggatcacctgaagttgggagtttgagaccagcctgaccaacatggagaaaccccatctttactaaaaaatacaaaattagccaggcatggtggtgcgtgcctgtagtcccaggtgagacaggagaatcgcttgaacccgggaggtggaggttgcagtgagcgaagatggcaccactgcactccagcctgggcaacaagagagaaactctgtctcaaaaaaaaaaaaaaaagacaacaacaatggccgggttcagtggctcacgcgtgtaatcccagcactttgggaagccaaggagaatggattatctgaggtcaggagttcgagaccagactggccaacatggtgaaaccctgtctctactaaaaatacaaaaattagtcaggcatggtggcagacacctataatcccagctattcagtagggtaaggcaggagaatggcctgaacccaggaggcatagtttgcagtgagccgagatcgcaccactgcactccagcctgggtaacagatggagattccatctcaaaaaaaaaaaaaaaaaagacaacaacaaacaagtgataagcaattcaagggactccattcacctgtttgaaattaataaaacacttagtgattagattaggttggtgggcagctgaactcttcaagattttatctatatctctttaagaactccagaatcggggctctctgttcgaatccagactctgccacttaggagctattcagttgattgtattaatcaagttaacctctttgtactctgtgtcctcctctgtgacagtacatgggaatcaaaatatctacctcagagagtcactgggcagatttagcagataaagcatgggtgttatctggcatatagcagtaagtacaaaaaagtagctacaataataataacataacatataaattaatataataacattgttaccattattggcagtagttttactgtggctctattttttagagagaagagagaagacacaaagttttgcccacaataagtggtcaggtcttggaatatgactagatgattgcttcaaaagagagaagtgttctgactgcttgtatatgtcttctgaggcggaaattgctgttagtaacaaccattttagtttacattttctaaatattattaaatccctgagtagtaggtaatattattgctattctgacattttcttctcatggcttaatttaaaagaatcaaaattatacccagctcagagaggtaaataacaaatgttctcaagaagcatctaaggccaggtgcagtggctcacgcctgtaatcccagcactttgggaggccgaggcaggtggatcacgaggtccggagttcaagaccagcctgaacaatacagtgaaaccgcgtctctactaaaaatacaaaaattatctgggcgtggtggtgggagcctataatcccagctactagggaggctgaggcagggaactccttgaaccctggacgtgcaggttgcagtgagctgagatcgtgccactgcactccagcctggacgacagagtgagactccgtctcaaaaaaaaaaaaaaaaagcatctaaaacaggggtccccaacccccatgacacagattctggtccatggtctttaggaactgggttgcatagtaggaggtgaccagcaggcaagcaagtgagcattaccacctgagcaccacctcctgttggattagtggtggcattagattctcataggatcgtgaaccccattgcaaatcgtgcatgtgaaggagctacattgtaagctcctgatgagagtctaactaatgcctgatgatctgaggtggaatagtttcatctggaaaccattcatctctcttgtccatggaaaaattgttttccattaaactggtccctggtgccaaaaaggctggggactgctgatctaaaagatgtcctcatcataatcacagataatgaatacagaatactcagtatcggaggaaagataaaaagttcagtttgggtcaatttcttcactatttacatacacttagggccttagacccttccatgctaaaatttaaatgcatgcattagctcatttaatctataatagccctataagtaaattgctattataatccttatttatttatttatacatttttttgagatggagtctcgctctgttgcccaggctggagtgcagtggcataatcttggctcactgcaaccttcacttcccaggttcaagcgactctcctgcctcagcactccctgggactacaggtgtgcaccaccacaccacactaatttttaaaatattttttagtagagatggggtttcaccatgttggccaggttggccttgaactcctgaactcaggtgatcagcccaccttgacctcccagagtgctgggattacaggcgtgagccactgcgcctggcctataatctcattttaaaagatgccattataaaacatctttaaaaatgaaatttattctctgaagtgtcaacataataagaaagaaaaaaaagacacttaggttaactaaagtaataaaggaactcaaacttgaaccaagagctatgtgatcttacatctcactttagtctgcatatcaaaccgcctcctagacactttgaggctcacgggtctgaagtgggtgtagtggcatcctgggaagatttaataggacaacaaaggtaagtcacacaatgagctctaaattctagtctgtccaaagcatgctcctttctaaaattatattctaaaatgttaagaaaaaatacaaaaaagggcattttcagaaaatgttttatagtccttcctctgaatgactaactttaccttttttctacattgcatattctttatcccaaacatatgcagaacatgttgatgtgttctctgattacaaagtgttttcaaatgataatgtaatgactcagtagacttgtgaaatgcaggcagaaaaaaatcatttaaaaccaaaattgactgtgctgcttctacctgctaagggaagtggtctaattcgcatcagaggggtaagaggcagagttcccttccccttttgtaaaagaaaaatggggacagcaagcaaaaaatcactcaattgttaggaaaaaatatctaagccaccctctcaccttccttctctttcccaagaattggttgcactactgaaaccagaggagtgcaggaattccactattttgtaaaataagtttgagccaaatttgcctgaatttctaagacaggctactttggttgatacacggattaagcctaaaaataaaaccttttgagataaattgggtagtacacccacagaatcgcgcccgagtcaaggagggaaatccttttggtattgtgtttaaaaatcatttttaattttccctacaacgaagcgaaactcctcacatgtgtttaattgttcgctctgaaagactacacaggccgttacgaaaatagtttttggcatgagtagtgatctagttataaatcagtgaaaaataaattgtgtccataaaaaagttacagaatttacccctgtgccattaaatattagttaacaaccttgatttttaaattgatgtgccatattctaccatatcgatactgtatttgatatggttcagttgcagactgctcttccagaataaataggcagaaaggaatttatcactggctgcaaaccattagatggcttacaaactgtttggaattgtaggggcaggcgctgtgtgagcgtttaggaacaacttccattctccagaaatggcatgggtagtcctgcgatccaaaggcagcagtgtcaggtggaagcgctagaagcccgaggctgccattggcagaacaaagcagtctcggcctggcttggcagcatccaaaaggaccgcagccgccctgccgctgcacacggtgcatctgattggcggaacccaaacccttccgcagccctccctgcgaagatatctgggaaacgtagtttttaccttctaacctctaaggcacggaaagcttattcgatgttgattgtaatggaaatagaactatgtattaggatttgtttaaccatcccttgagttttaaattttttggttgttacgtaattttctctgtaataaataaataaaattccctaaacaatatgaatacttttcaaatttttgataatgattgcaaaattgctctcttgaaaagttatgccagtttatactccttccagcaatctttgttccatattgtcagtcatgattaatacatttgtcaatgcttttgaaaaggaaagtgacatattatttaaaaactatgaatttctttggctagtttgaagattttaattctcaccacaagtgaattacgattagatttttttttttttttttttgagatggagtctcactctatcacccaggctggagtgcagtggccaatctctgctcaccagcaacctccgcctcccgggttcaagagattctcgtgcctcagcctccagagtagctgggatttgaggcatacgccaccacactaggctaatttttgtatttttagtagagatggggtttttgtcctattggccaggctggtctcgaactcccgacctcaggtgattctctggcctcggcctcccaaattgctgggattataggggttagccctcgcgcacggccgcaattaagtctttagacgatctgtttccccagtatttcccagcaatgtatttatgaatcatctcgcatctcgcatggtgagaaacttaacatgaacgttcaaccatgtaaaattattaccagtgaaataaataacttaatgtctagtgacctcttactgtagctctgtattggtagatagacacttcttttttgatctttcaagtatatagtaaaaaaaatgttccttttacagttttcaatttttttttttttttttttttttgagatggagtctcgatctgtctcccaggctggagcgcagtggcctgatctcggctcactgcaacatccgcctccccggttgaagcgattctcctgcctcggcttcccaaggagctgggattacaggcatgcatcaccacgcctggctaatttttgtattttctttaaattagagacagggtttcaccatgttggccaggctattctcgaactcctgacctcaagtgatctgcccgcctcagactcccagagtgctgggattacaggtgtgagccaccgcgcctggctaatttttcatgtttttagtagagacggggtttctccatgttggccaagctggtctcaaactactgacctcaagtgatccacccgccttggcctcccaaagtgctgggattacaggcgtaagccatcgcgccctgccttgttttcaaaattaaacttagttgaagcctgtaagacttaaaatgaaagcaagattatgtgacttgattatgatgcagccaaatgaatttagatgcaaatgctagacttgaaatgtaagtgtacgaatatacagcagtataattttatgaggtctgggggttacttgtgcatgagcccaggatttagatatctggctactcacagtaagatccatggaaggaaataaattctataaggaagcactgtataactcaaagaaactagagaggcccaaatgtccaaagctgccatttcgcttgctggaatttgctggtggaataactacccttccccgaattaatgaggctaaatgaattcctggggaaccctcaggctgtcagtgtaacacctcccacatcttttttctccagcaggtggcatgtacagcaccatcctgaaatggtgataactttattattattattgtcactattcatggggctaaccatcttcccttttcttcccaaataagtacatggagttttagcataggtattaaagaaggctcgtcagcatgatggcttaagtctgtaatcccagctactggggaggctgaggtgggaaccgaggagttcaaggctacagtgagctatgatcatgccactgcactatagcctgagtgacagaaggagaccccgtctgtaaaaacaatttaaagagagaaagagaaagatagagagagagaggattcttgtttcaatgacctagaggaaaaaagatgttataagttcgcttttgaaactggaacattaatttttcaccatattaagacaagaccctgtatatacacgttaaacttaaacagctatcttttaggctgttgaatgcaagaaggtaagtttaagtaccatctagtggtaggcatcaccctccacctagtggcatccctctccatctagtggcaagataggcgaattgaaagcaagtgccaaagaagaaatagtctgatactgaaatgttgagcaaaagtttaaaaagacaacagtattgaccacgcctcctccaagtcccagcgagcccgtgtacaacctgtcccgactccagccgcctcttcagctcgccatggatcccaactgctcctgtgccgccagtgactcctgcacctgcgccggctcctgcaagtgcaaagagtgcaaatgcacctcctgcaagaaaagctgctgctcctgctgtcctgtgggctgtgccaagtgtgcccagggctgcatctgcaaaggggcgtcggacaagtgcagctgctgtgcctgatgctgggacagccctgcccccagatgtaaataacgcgacctctacaaacctggattttttatgtacaaccctgaccctgacgtttgctacattcctttttctatgaaataatgtgaatgataataaaacagctttgacttgaaaaaaaaaaaaaaaaagagaatagtattaaagtaccagataaactttaccactgttttattaaattttaatataaataaactatgtaaaataattcatgattgtagcaggttatctaatttggaaataaaaagaatactcttgctggatggtaaacagactattcctagcatgaggtcttttcttggaattattttatcttagtccttacctagaaggacttaggaagtgacaaacagtgctaaaaacctgagagaaaagttaagacatagtgacagaattttgcaggacaaaagagtgatattagtacagtctttcttatgttaaaccttttatgatcttgaaaatcttatctttaaatcttaagaagctgttggattatactttaatcattgcagggaaaagatttagaaattatgttgtcaaccagtttagatcaaattgacatcagaattgggtctttaggaggagatttttggtacaataactttgtaatctgaggatactaatcagggtataatagtacacttaattagtatgattagctgatagtctcaagttaggatgacagtcattgagcccatatcaggtagttaacagtgagcatctatctgttctaatatgttcagcattctgttaggattagttggtgtccatgctgtccttgttattaaatcatctgaatatcatccaagaccataagggactgtatgttcacaggaaaaaaataacaaaatcacaaaatgtgaagaatgtatgtattatgaaaagaaggtaggcaaacagatatctttaaaagaggaagctaaaaaaataaaaataaaagaggaagccaaatgaatggatcagatagaaaaaaatgttcaaaagtgtaataattgttttaaaaggactaaaaatatttttagagacccaaaggaggaaattagaaacatgaatcagaaaaatcagttatgaaggaccaactggagatattcagtatgaaaaacctaataactgaaataactcagtaagtatggtattagataaaccttatagatgttttttagatactgcttttcagagtgaacacacttgaaatacaaattagtgagctgaaagatcaggtcaatcaactcttctagaaggactcaggaaggacaaagcagtgctaaaaaactgagagaaaaggtaagatacagtgacagaattttgcaggacgaaagagtgatattagtacagtctttcttcagtatcttcaaggattggttcaaggacccactgccttcatagtaaaatccaggaatgctcaattcccttatataaaatggcctgtttgctcataatctacatacatcctcctgtatacattcaattatctctatattacatatgatacctaatacaataggaatgctatgtaaatagttgttatgctgctttggtttttatttgtatttttttaattgttaatttggttttttcttgaatattttcggtcccaggttgtttgaatctgtaaatgcagaacctcaagatacatagggctgagtgtatttgatagaaagaggacagagaaattgttgaaataagagaaatttgaagctaggatgctatatccaattaattcaatgtaaggctgaaataagttattgtaaggtacacaaggcctcagaaggctgacaaaaattctgtttgaaaacactttgggaggatgtgctcaagtaagacaaggaatcaatccagaagttaaccaagagatgtgaaaagtgtggaacaagtgaagctttgtaacgtgtttagataaaaaactgccagaggcatctttaatataaacagcttcaggaagagagacacactgtattgctttctttatcccagagattttggagcgtatacataggtgtcatgcatgtcgtatgtatatgtgcgtatttgttggaggaacaaagcccaacccccacccccgacaaaatcccatgagtttatttacacattgtacatgagaatttgcgctatttcctatcttcagacatgatatttaaaatatataacaattagtacaacatagggcactgaccaatcagaatagacaccagccaaactgctagagcagcttcctggatgctgtgcccttcatgtccggattatgagtacacctctggtgggctggggcagaggcatggggcaggggctcaaagtggcttctatttaccatgtatataggattgtttcaatattttaacaacttgtatggtcatgtatactgactgaatagcaactctgctatgagacataagacatgtttgatgacttcatgcaattttctgaaacatgctctttttttttttaaataaaccttgggcagatgttatgttaagacagtctctgtagtaaaataatttgccatattggagaggcttatcatctttacaatgaaagtcagaaaatataagtaaaacatattaagttgtactaaagcagagagaataatcaaatataatcttactcaagatattttcatgacaactcagcttgcaagatgttttcctaggcttactgggtcataaatattcggtatcattttttttcctatattttaaagaaaaggaatttggaacacgtaaactataaatctaagttttaaaaaatctaaacaacagtttcctctcattgcagacctcattcaaattgcaggctggagccatgcccaatatgcctcttcagagccacaactacccacaggtaggtgggcacttggtgagtgaggataaaaagtttgttgttataagtcattgagttgtgcagttgtttgttacacagcaaatgacattccttttttacttattcatcattcattcaacgtattctaaacatataactatgaactataaaaactcaaaactggcttttcttttaaaagactgactagacaaatttatgttaaaactaatcaggaaaggaatggagatgcaaataaacaacagcacctatgaagtttgcattctactattgaaacagaaaatacacaaataaactgggaatcccaaatggttcataagcaaacgaagagtgacttacccttactctgtaatcagagaactgcaaattaaaacaattggaaagtctgacaatatcatgcagtggtgaggatgttgggaaataagaaacctcccattcaacttaagggaaagtaagctgttgcaaccattccagggagcaacatgaaagtacttggtaaattaactatctttatactttctcaatgatgtagcaattacacttctaggtttcttgcacatgtccctaggaatatttttcacagcaatgtttgtggtagtaagaatggagaaagtctagatgtccattgacagaggaatgggaaataaaataagggatagacacataataaagttatattcagcactcagaaataatgttctagattaatatttatctggatggctcttaaaatatcatgacaaattggggaataaacaatatgagatttataaaagaataactttcaaggatattacatgcatatgcccagaaacaccaaattcatctttaaagatacacatatatctaaatgaatatagcaatgatatactggtagggtataaattaaatatgtaagggtggggtgaggtgagaatggtggatgcatgggaaaaaggtagtaaaaagtagaaaggtaaaatttaaaaaggggtattgcacagacgctgaaaatgtgcaatgaaatgaagggtgtgattaattcaattttgtgacttgatagtctaaaaataactatatgtagtagaatctgaaatatgaggaatagggaactttaagggagtatatggaagtcaacgccgtctaagcatgtgcacactgaattctcacactttcgatgatgtcctgctattatatcttttctaagcttagaggaagataaataccacagtagttatattttaattctagttttatttaggtaaatgataataatgagataagccacaaagttcgaattgacatatctattagtattagtatacataaatgtagaaaatatatttcaaaagaaaaaagaacgtactatgatcatcaaaaacctcacctttccacatgatacatattgttgatattttgatatttttccaccatggaatttattttgcaattaccttgttaatcagtataatgtataatgtgaggattaaattgcatctatggatcttgatgtgttatctttagaacttatttagattgaagctttcattttatctttttcaaactactatattaatgatcttgaatgaagattattataggagttcagtgcctcgcaaaattttcttgtacttaccctgtgcttcatactcttattgtcttgcctcctttgaataatcacaaaagaaaaagaaggcaaaggagtatatagcacaacctattagaggaaatggctgaaatagtattctcttaatgtttaatgtgactattaagagggtattatgctggcatgtaaaacagttaattgtattcagtgtgttttaacatcactgattaattgatggcgtagtgaatgttcatcttggagaaaataccacctttgtatctcaggggatctaaagaatgtcttttgctgctgaataaagtgcttcaaaaagttcaaagggagaaatgtgtatttttttttatggtaaggaagaatagattttaccacttgggaaagtaacagcttatgaaatcacgcagtgatgactgtaattcagctgtcgtctgtttctttcaccttctaaccagtgaaaaaagttaggttacttatttctttgactaagtaaattgaaaaggaataaattcagaaagattatctaaggaaactggttattagagcaaaatggtttgtattcactctgtaaatgaatgctcctgctgcttttctcttcattttaatcataatatttcttttttccagttgcttcatgtgaattttattttattgtttgtttttgtttttgagatggagtctcgctctgttgcccaggatggagtgcagtggtgccatgtcggctcactgcaatctcctcctcccgggttcaagcaattctcctgcttcagcctccccagtagctggaactacaggcatgaggcaccacgactggctaatttttttgtatttttagtagagatggggtttcaccatgttggtcaggctggtctcaaactcctgacctcaaatgatctgcccgccctggcctcccaaagtgctgggattacagcttgagccactgtgcctggccgtgaatttttaaatatatcacatttcaaaataattttgcagttccaaaataattattttgtaattcaaagacagttgaataagcaaatcccttgggatttgattgtgtcagaattataaggtcctgcttatttttatttttatttttggaatttgtctgatggttgcagattattgtcaccggttcctcacgtttgttcccaaaagaagtaggatttgtgagacttggttccacctttgattttgatccatccctctgaatcaggctaagtcacagactccctaggtcattgccacaattttataagtaagacaactaaaaataatctatagtactcactttcaaaagatcaatcactcaattcactgagtgttaataactgatttagctcagggagaaggacatttctcttattattctctataagaaggtaaaatatctaggttcttacatttttgaatagcaaagtaatgttgaaattagatggacaccttgacatgaatctgaataaaaataacatatctcaggaatcttttagtattatattattgatataaaaattattaaaataggctgagcgctgtggcttacgcctgtaatcccagcactttgggaggctgaggtgggcggatcacgaggtctggagatcgagaccatcctggctaataaggtgaaaccctgtctctactaaaaatacaaaaaaaaaaaattagccgggcgtgacggcgggcgcctgtagtcccagctactcgggaggctgaggaaggagaatggcgtgaacctggaaggcggagcttgcagtgagccgagatcgcgccactgcactccagcctgggcaacagagcaagactccatccccccaaaaaaaaaaaaattattaaaatagcaatattattaatgtctacacttggtcttagccaaaaggccaagaagatatagtttcttaaatttctgagatctttctaatttataaaatgctttaatatacagctttatttttattaatttaatttaatttaatttatttattttttagatacagagtcttgctatgttgcccagcctagacttgaactcctgggcccaagtgatccttttgcctcagactcctaaatagctggtactaggcgtgcgcatcactgtaccttacctccatacgcagctttttagaggcagaaactatttcactgacttctatcccttaaacccagaaattgccagacataggttaataagtgcctaaagtaaacttcagtcttttgttgctgtttcccacctcctatatttgaggaattctctgcaatatgtatctttaacagaagctccaaaggccatgtgctctatatcccatctttctcttcaactacagcacagtaacgtaacttaggctcacctgatcagctgtacccagttgaactttcactgggagctggtgatgcaaaagagtagcaatggtggagaatctattctgatagtggcagcagtatagatagcaacaacctgttccagggcagtagtggaaatgaaactagtggtggcatacggtggctggtgcctgaggtgatggctgtacatgtggtggcatccagtgttcagccatggtgggagcagtccccttatgaccctggatctatggttttacttgtggatctggctggtgcatagtgctcattgttgatcttccctttttcaaaacttgtttctttattcttcttgacaattctcttagatatataaaatccttttaataaattctgtttaaattagaattggcttctgtcacttgcattaatatacttgacaaataaaatatgaaactgacttgcatagctctataaccctatcaagacaggttttacgaatactgtttatatatcagtaagcaaagactaagagacagtaatttacttggctaagattaacgtttagtaagaacgaagagccaggaatcatacatagtcactccgattctatgcctgggtctctttcttccctatcacagtgtggcagagatgggttaattttctaagtacacagaaagcttacatttcacaacttctcttttaattctcagcatcatcacttggtgtagagtcccccagagagcaacctgatccatatcacaaacctgagacaaattttggttgccttaagcccttacaatttggagtttattcttatagcagctaatgatctttactccaattaatgcagaaattagtaacaaaattgaggtgctgtcataacaaaaacttaaaatacgtgacattgacagctgttagctggatagtgaggagagagataccagagatctatgttatatggtggtaaaatttttggtaaatttattaccttcttacaagacagaaaatgtacctactgggcttgtcgttttagaggaagagtttgcaaaatcaaatgttggcagagtttgttgggaccgttggcttatttggaaaagtgtagtaataaaagagatgttcccagaagaagattgaccaattgatgaacagaaatgaaagtagagagagaacagaaattcagagcttttcaagttgaatagtcctaactttgaaaccctaaatggtaagaaatggacttacaaaaggctttgaatgaaagaagtccagtacaacttgacactaatagttggataaagggactcacagcaaagatcagattagggtatgccttacacattgtttgctccaaatagactcaaaatacctgccattaagtaaaaagaggaaccacagtggcaaagaagcaacacagatcagactagacaatcatttctaggaataaactattggtatagttactggcacgtggatttgattggaaacaaacagatagaagaatataaaattttgaataaatgattttgccaatggagtcatgaaattgcaataaaaaaacacgtaagatatcagaatttaacacaacctgcatgtcctagaccttcaagcaggtggcaggcagtaggcagtagacttgcacattcatatagctgccaaaaaggtcatgtgccccagttcccactgcagatgcggtcaaggagaataacagacagggggataccttccagagggtgaggacattgcataaaagaactctctccagaaggcataaacagtgcctaatgaagaatttctcctgtccccaaggcaatgtctgcccaatgggattttaaaattgccccaaaccagttgctgtgtttctttttccccttctaaatggaagcgtctattgtggtaattgtaacccttctccaccgttgtaattagatatgtatttattgtctttttagttcataggtctccggagcctggggcatcgcatctagatggaaaggactgaatatcaactgaagagcctaaattttgggctgatgcagtcagtgattaagagttttgggtcagtgatggggcgaatatgtttcatgtgtgggaagataaataaaaggggtgatgcatgaccagaaaggaggactgtggcagaaacagcctagatgctcaccaatcttatttctactgtttgggcagatggaaactgctatagttcaaagcctctcttggagttagattgcaatcatatgaatgagaaatagaatgtgagcgaaactcactggtgtcacttccaaacttggctctttaaatgttcttcacaatcattcatgtactcactctactgtcttatgactattgtacatattcatgcacataatgatgtttccatacatataatgtgtaataatcagatcagggagagtcgcatatctatcagctcaaatgtttatcatttctctgtgttgggaatgttcaatatcttccttctagctatttgaaactatatattattgttaactcctgtcatcctacagtagtatagattattataagttattcctcctatctagctgtaattttatatcctttaacaaatctctccctgtctctcagtaaagtatcctgagatagtggaacttctctggttaacacttggaaaagaattgctgaaaagagccgtctcaccaactttgggctgtgattttgttttgtgaagtcattgtgattttgggatggttgtttatagcagctagcaagtcttagcatggcaaatacagtaactgtcatactaaaaaatatgatgcagaataaattatgttaggtagattaaataaatctatattattaataaataatatttgtaagtctgaattttatctgttggaatgtcagaaaagaatggggattatataaaaaagaattgttagaaaccagagtgtatcctatataggatcattagtgaagaaatagatggaaaagtggaaatgaataactatttcttccacacagaataaaacccagaaacaaagaaaagttaagtagtattagatagtgattcccaagcctgggaatgggagtcagtgatactcacctaggagagaatattaggaaggagtgagtgacatgaaaaaaaagtcacggagggaaagggtaaagttttagtaagtcctatggatgacaattatgtattacctgcagcttgtcctactagaggaatagtctctgtgccaagaggaaaaaaaaaggctcagaatttctgatctaagacataggtaattaagaactcaaaaggaaaaatgtagtcagtgtataagatgatggaaatcttgttttaagagaactgaattattggagaatgtgtaaagaagaaagaggtgttaaacttttgaaggggagtcagatttgctcacatttttaacctttaacagtttcccacttttttttttgaaacggagtttcactcgtgttgcctaggctggagtgcaatggtgcgatctcggctcacagcaacctccacctcccaggttcaagtgattctcctgcctcagcttcccaagtagctgggattacaggcccgtgccaccatacccggctaattttttgtatctttagtagaaacagggtttcaccatgttggccaggctggtctggaactcctggcctcgtgatctgcctgcctcagcctcccaaagtgctgagattacaggcgtgagccacagtgcctggccatactttattctttatgatacaatgtctcactctgttgtccaggctggaatgcagtggcagaatcacaggtcactgcagccttgacctcctgggctaaagtaatcctctaccccagccttccaagtagctgggaccacaggtgtgcaccaccacgcctggctaatttttaaattttttgtaggtatcactatgttgcccaggctggtcttgaactcctgggctcaagcaatcctcccatcttggcttcccaaagtattgggattacaggagtgagccactgtgcctggcctggatgggtaacctttgaaaagttatgtaaaatctgtgtgcctcaatgaggatagtaatagaaacttccctggaattacttgaagtttaaatgagttaatctatgtaaacaacctagaacgggccgggcacagtggctcacgactgtaatcccagcactttaggaggccaaggtgggtggatctcctgaggtcaggagttccagaccagtcaggccaacatggcgaaaccccatctctactaaaaatacaaaaactagctgggggtggtggcacatgcctgtaatccccgctcctcgagaggctaaggcaggagaatagtttgaacacaggaggcagaggttgcagtgagtcgagactgtgccactgcactctagcctgggcagcagagagagactccatctcaaaaaaaaaaaaaaaaaaaaaaaaaaaaaaaaaaaaaaaaaaaaagaacctagaacaatggctggcatagaggcatagaataagcattatatgtattagctatgattacaaaagaggaatctataaggtattctgcagacaaagagaaggaagtggctaatttagtctgcagagtagagaagaaactcagagagctgcaatttgcaaagcaaggaggagagatgaatatttgttttgttttgttttttgagaccaagtttcagtcttgttgcccaggctggaatggaatggcatgatcccggctcactgcaacctctgcctccaggattcaagcgattctcctgcctcagcctcccaagtagctggaattacaggcactcactaccatgcctggctaatttttgtgtttttagtagagacggggttttaccatgttggccaggctggtctcgaactcctgacctcaggtgatccacccgcctcggcctccctaagtgctgggattacaggcatgaaccaccgtgcccagccgagagatgaatattaaaacatatttgagggactttagaaattgtcagtctttaaagtctgtaagaaggatggtctggatgactcctttagcatgaactcattatttagtagatgactccatcccagttagtatttatgcctgtggaaatctcatatgaagagctagatctgatcagcagctctattatatctagcttaatgctcacaatttgttccacaaagccattctctctctctctctgtctttccctccttccattttgttagatcacatattataatagttatatgctttaaacccttatttggaacaataaagatgactgacttacatttcagacattgtcgctccatgtcgctagttttaaaacctgcccaacttagtaataaaaagtaatggctcctcagataagagtttcatgatagtttcttagaaacgagtcaatgacactactgtaatagcaggggaaaagatttctaagtcacatcatattttcaaactgacaattttagctacaaaagtacaacttccaagaggtctttcccaggtaaacatggaagggatttaccagtccacagaaaagtgactgcctctcccttggataaatgagattctttgcttcctgaaaatgagaaactgctatttcaatttcaatgccaaagatcaaattttctgactactgtgaatgaggctgctcagcatttacaacactaaaaacaaagaaaagaaagccgaagaggaacaatttttttttagcatttgccccaggcctttgcaatcaaagcataacccagcttatttttggggtgactacaccctccattctccaggtagttgaatcttccttgcatgtgtgaaagcatcactgacaaagtttcgttgtcatggagtttttagataagtatctctgagtttaaaatcccaaattatatgcatccacccacccttatactataattaatatctgtcttggggctttttagaaataactacacacatcaacagtttcacaactgcttctgtgagtggtgagattagtaggcagatttctaggggaattatgcaggtgaccagtcattaatatgcacattgttaaaatgtttgaacgttgtcatgatgatgatacagcgccgatgagtggaggaacaccaagttcttcgtcctcatgctggtttagataaaacgacactgacacacgtggagtggttttaaggagcggaaagtttaataggcaagaaagaaaagagaaggcagaaggaagaggctctcctgtacagagacagagggaggggggctccaaagccgagagagggaaccccatctggcagggataccagccaggtatatatacagaggctggaggaggcagtgtctgatttgtatagggctcaggggattggtttgacaaagcatgtcattcatatagcccaggaaaaagcctgccctcccaccctagccttttaatatgccaatgcagggcaccatgatgttctacccacgtggggatatgtgggggcggccatgttgccaggaagtgtggggcaaggtcaagatggcagtgggaatagccatgtttgggtggacccagtttctaatggatggcatttgcatatcaaaggttgccagcctggctctaagagctgctttaaaaacgaaaacttcccaaggaccccttttcctctctatctgcctaaaataatttcttaataactcctacaacaatgacaccaaggggccaaattctaagattccaccaacatgatgcagttggcttggcacttcataactcaattaaagggatttttgagggttgttgccttaggtgtacactgcatgctttgaagtttttcctcataaagaacataatgcagtaacttaggagagaccattaaagcatttttccctttaagaactgcagcaataattataatctggtagctactttcttatgttcttgtaagataactagtcatcaacaaatttttttctctattaatttcactgcgatcaaatatttctcaatgaaaataaaagataggaatttcctgtatatatataaactcagttattttgaaacaacacataacattagaattgagaaagaccatggaaatattgatttcagtgtgaatgaaaaagaaaaacttgggaccttaattcactatgccaaaaaagaaaaaaattaagctgaaagatgagtcatgcaagaaactgcctttccttttgttcctaagcagatagctacagataaaagttaaacatctccactgactgctactccatgttcaccttattttatgtaaagtgccgatttactgagcccaagatcaatacttaactgacaattcccctacttgttcattttcctctgcagcttgtggattaccatactctccccttttcccctccagctggcttttcctctttaaatattgaagcctgcaaattcatccttggagaaaggcacagaccacagactgcttctgttattccatgttcatttcttcctggcatgtccttaaccttggcaaaacaaacttctaaatctatttagatcacagaaaggattttttatttctatacttctttaatgtgtttttaaatgtctgcctaatagttcatgcagttgatattccataatctcatcatgattgagtttatttctcagctgtatagaagaggacacaaaggaacagaaaaggcaagtatctcatccaggatttcctagctagtaaaatgaatgcaggaaaaagggaaaggccaagaacagtcacatctatctgtcttttcattttgtttcttcttttgcttttcatgcttagaaattctttctccgcctagagatgagatgaatattcaattatggtttcttccaattgtttctggtgctcatttttatatttatatttaacctaagataatctggaatatattttggtagaacaaataaattagatgtttgttctaagagaagtcttgatgaaatgattaaaaagtttatctataagaattaacagataatacaactgagaaatctttaaaaggaagagtactggaacaggtaacttgtactgacaaaaattgaaactgataatcatcgtaacaattagattagcatgcaccgttttaaggaaaacaagatcaattctatttagcataaaagcagcaattaaaatgatatgaaaatctgtttttctcagacagcatattagtttattaatttagtatttgataattttttcagatacagataatatctaagtgataatttaaaaaaatccaaacatcctaaataaaaatctaagccaaaatctcataacaagcctgtctcttaatgagctgtgacagtgaaataatcctttttacatggtgatagctgatattgtgatagctgtaaacttagctgtcatcacagatcttggctacagaggctgctgtggtaacgagtgaacctaatgggctttgtttacttgagtgaggagttttcttcatgccccaaccctgcctgcttgcaatgtgcatctgaagccaggaggatgtctctccaactgatcgtatatttctttcttgtttttcctttttttttttttttttttgagatggagttttgctcttgttgcccaggctggaatgcaatggcacgatcttggctcactgcagcctctgtctgctgggttcaagcgattctcctacctcagcctcctgagtagctgggattacaggtgcctgccaccacccctggccaattttctgtatttttagtagagacggggtttctccatgttggccagcctggtctcaaactcctggcctcaggtgatccacccttctcagcctcccaaagtgctgggattacaggcatgagccaccgtgcccagccagatcctactatctttctacttttgaattgcaatgtggtttatgtctttggattttaataagcacaaaactcctcctagaattagcaagatatcaaaaaaggcctccaagtggagagcatttggccttgacctcatgtaggaaagaaaggagttggccaggtgtggtggctcctacctgtaatcccagcattttgtgaggcagaggaggatggatcacttgagctcaggagttcgagaccagcctgggcaacacaacaaaaccctgtctccacaaaaagtacaaaaattagatgggcatggtggtgtacgcctgtaatcccagctagtagggtggctgaggcaggtgagttgcttgaacctagaaggcggaggctgcagtgagctgagattgtgccactgcactctggcctgggccacagaatgagacactgtctcaagaaaaaaacaaaacgaaacagggagagtttgaagaacaataattctataattaaagtgtttttagaatagccctcaaggatcctctttctatcttttatactaccaaacctataaacatatatgtggtttccaggatgaggaacacaatacttgagatggaaaactaaagaccggctatgagctccaaggttgaggaacatatttgctgaacccttttccttaaattacatttatagaaataggaaaaatggaatatctccattaggcataatttaaaagcactgaagaagtgtagggatgtgaaaacacttctaaaaaagcaagcttggcaaaataccaacttttctcgaggaaccaatccattctatttttctgtttgtttgtcccaggttcttaagcagcatctgatttctaaactcttacaagggtagtctggataaagcacgttttattttctctgttgaaaactaagtattgcttaaatggagaatcatgccttatttggtagtacgcaaaggtttaaggcattttttttccttagatgagggatatcaatacagaaaagtctgtcactctgttttaaaatttatataagctcaaagtttcaagtgctagttcatgggggaaagaatttgtttattttttgtttttgcattttctatgacatcttttagcataaagccttacagagatcatttttttaaatagtagaaacataaatgcttattgaactgagcactctagccaaggaaaaacttttcattaattttgagataagaggcaaaaatgaaagcatattataaaccttactgattatttcttccttactttggctattggccatcttttagttgaagcatatacatttattaaatgtattaataaatacattaaattaataaagtcccatattaaagaagtttatggaaagatctctccttatgtcttagtgttctcttccaggaagagggtatacagactttatagaaagtagatattccctcttatcttgtaatatatgtccttgtgcagcatgagaagaaaactttaagatcacagactagcctaagaaaaatgatttatctttcagcaaatatttctcatccataatttactttggcttacttctgtgtctacaagtgtctgttgtagcatataaatgaaactagtttcaaacaacttttcaggtgcaataacaaaatgtatgtaccagagcttctggatagctgaacacatgtcagttcctggagggcggtgtgcccagggatggcatggaagctctgtgccccttcccctatgtctcaccctatgcacctcttcatctgtatcttttgtaatatcttttatttactttttttttttagagacaaggtcttgctctgtcacccaggatggagtgaagtggtgcgatctgggctcactacaacctcctcctcccaagttcaagcaattctcctgcctcagcctcccaagtagctgggattaccggcatacaccaccatgcctggccaattattgtatttttaatagaaacggcatttttacagtgttggccaggctggtctcgaactcctgacatcaagctatccgcctgcctcggcctcccaaagtgttgggattacaggcatgagccaccgcacctagcctgcaatatcttttacaataaaccagtagatgtaagcatttccctgagttctgtgggctgttccagcaaattaactgaacccaaaaaaggggtcatgggaactgcaacttgaagcgcggtggtcagaagttccagaggcccagacttgcaactggtttgtgtgtagttggcagtcttggggatggagccctcagtttgtggaatctgactctatctctgggtagataggattggaatggaactaaagaacatccagctggtgtctgccgcttggtgtgttaggaaaaaactccatgcatttggtcatagaattcttcttctgtgttgatgactgttgtgttgtcagaggagagagaaaacacagttagggagagttcccctacacaattgatgtcagtgaaatgggatttgctagaacagccctcactcacagaaacatgtggtttaggaagagaaaggctaaaaggctgggaggatgaggaatctttgattcctgggtgaccatcgtggtcacccatgatatgaagttgcagttgtgttgagatcagttactacaggtgaaagttaccagcggaatttagagatggatagaactccccaggaattggttcactggatgcaaaagggaatgcaaactaataagaaaaaagcaaaatattcagttctttggttgttgttacttaaaattgctaaaatgaaagtaaaatagggtgctgcatcaggacttgaagttggaccaagttcagatggggacatgtctgagcttagttaggccactagcctcaaagtcacacacaaaggagaaaattatgcagggacagtagaaagtacctctgaaacctgtggaagacagtcaatgtgaaggcagggcaaaaccaagtaactatttaaactattagagtaggtagttaggtaggcatgagcaggacaggagcgaggccccatccagaaatgccaggcaaccatcaggtgatggttagttggttgttaaactgttgctctaaaataataattgttcacagccaatgcagggaaaaacagtctcccaataaatagacaatacctgaaactggtgatcagcagcttcctgataagatttcaggagttgggtgaacaggctcaagaatgcccactaaaaagcaaaatggcagagattaactggtatatgatctttctctaggaaaacttgactggtaaggaaaaaatgcctcaaatgagcatgtgtacaactttggcaaacacagtgtgcatgttgcccctccccaagtgctggcggaccagtgtgcatgcagatagcccaccccaagggaagaatcaggggagaagaaatgcaaaccttggaacgatgccaatgtattctttcctccttgcaggcaagaatcgtttgctgcagacctgttggattcacagctggtaacaaaaccggagagtatagtgtgaaggaattgtttcatttttgtagaatggtgttatcagcttcctgaggaactattgctaaaatggattataagaatgacaaatgtaggggcagtgtctttggtttcaaatcttgcagagtgaagagcatgtttgggttgatataggacccacagctgaccatttgaacaatcacagatgggtatatatgatccagatatgtaggttattccgcaaggaacagccagtctgatagattggataaaagccattataagatctatttgagaaggtggactgttgaactccacctataaatgccaagtggaacaccttacataaggcagctgatacaattcatatgcaagccatgtgtgactggctttatgaggacatgaatattcactcagtgaatatgtccattacccaggtcacggtaaatactctggttaaggggaccccatgtgacattactcctgcagactcaaatagttcaagaagccttatcaaatttgtggactgagtttcccctcatggatctcacagatgctaataaaaacattaggttaattaataagagaacagtgaaaggcaaaagggagagtcaaagactcatccccggaagatagaaattttaaaatggttattaaaaaataaggtgaatgaagaaaacattgatggggtgaaactaagaagaaaaagaaaggggagagtcatgggactcgtcccagcagaatggaaaactttagatgcttattaagaaatagaatcaataaaatagacattgatggggttaagcaaaggtcttaatacaacactattgtaggttggatggaccagagggggccccatcttgttccccaacattaaaaggccgcaaaccagtctgctgtatttctgccagcttggagaaatttaaaaagctggaaggcagagattacaatgaaaaatcagatctaaaattgcctggggcaacagtcaggcagactaatcgagataaagattaataaaagggccagggtccttgggctcaatccttggctggggacccaaagctttttacacaagagagggtaaaatgacctgggggtaaagaagagaagatcctgaaactagaacataaaaatgtaagagttgataggactatggaagttggtatatttgaaaacactttatgtgaagtgattgcatctcttttacctgatttttttttttgtgggaatgaacaaagtatctcattgggaaatatttctcctccctggtgctgtaaaacagaaggcatgtaataatctgccctcaagcaatattaattggacatgctaaatgggaaccagtgagattgcccaagtccacacagtgcagagtagaagctagaatgctgttatggataaattctccacttgataagcctctgtgatgctatttcctggatcttgtggcaaaagcctctgagcacctcccagcaacatctactgggactttggactatggaacttccatctgaggggcatttactgctttgctgtgaaatgttaggtgaagctaccgctattaacacctgaaatacccatgttggcccagcgatgtcagagaaacattctaacagggatggcagtgcccaggagagttccataataaaatggacatggtttatcgaggatcatgccacctaagaactgcaaggaggggatactcttgagcagggtgtttcttttctcctgagactgactctggaactgtgtgagaaactgctggattctacagtgcctgataaatggctctcaactcatgagaaagagctacttagtttgtggccggtaattccaaggtaaatggacaccattgtgtttggaaggcagctactttgataaaagaaggtaaaaacagatctgcttggtgggctgaattgcacactgtttttctaacagtgatggaagaattgatcaatggtaaaagcccctgagtttgggtgtttactgagctgtgggcagtgtgacccatggcctggccatacactcaggcaagagggccatggaaatttggcctattaaatggatgcacataggagcactgttctatggagatttgaggggtgcattaaagaagaacaagtgaatgcccatcagaagaactcccttccaggttcagaaagtgactggaattgacaagcagatatccccatgtactcccttgaagtggccacctgggcctttgaaatgagtggatatgggggtattgtaacagggcagagatgggctgaatgtagagatggtttttttgcaccttctcaggcacaaaatgccagaaagaactgttgtgtttctcaataagaaagccagagactgctgacggctttgggacagattctctggtgggaaggccctgaacatagctggcaagtgcgacaaatgctggtagccctggaggctacaaatgggtcttgacaggaatagacactggctatggagtggatgttgcttgcccagaagaagatgaaaattctctgagtgccataaaaaaccggaacagaagatattacatggatatagatggctaaccatcagtttttcagaccaaggaacacactgtacagcccataagaatagtccaacaatggacaaagagatatccacctagagtaatagtttgatagagcagtagagcaggcaattgaaacattgattgtgtaaaacagggggagataaaagcacaaagggctggctcacatgccttcctgtctgctcacactcaacatgagcaggactagagtgtttctgctagattttttttctttgtttttctggttgatctggggaacagggagttgggaggatgctggtatgactatgccattcttgccaagggacgagtacactggtataacaaatgtaagtttttctttcttccccaaatcacctaaaagaaatttatttttttctcccctggctgatgcagtggtcctaggaccaggactgcaattacaactgctggattagcaggggtgatttctaagcaaaaacctgtaactgtgttttgaaaccttatatcaaaattcccaaaggcatgatgggagtgggttgtgtcttcatgctatctagaaaaattggggctatcagtgaatgcagctatattgcctggtggtaaaaatagctcactagttctgcacctatgtaaccttacccggtctgaattggcgtggactgaggaggagctaattgctagacttgtattactacttgcaacgtagaccggcactgtggtggttctaatttctcttccaaaggtgaaaaggtttaggtattaatggagagaaggagaaatagtagctgagagtaaataaatgaataaatgagttattaattgagaaaaattcagtattacataacaactcaaaagagtctcagagcaagagatgacattgtctcttagcttaattatcccagatgccttaaagggtgaagctgcgtatttactgaggccactcctgctttcgagacctgacaagattgagaggaaacttgcaaccctgagtggcctcatcctggaagacattcaaacaatatgaaggatttgattaattgttaatgattgtgcataatatatatatttttgaagtaaaggcaccatggtggaaaaccagggagtggcctgtggtgttatgatatacactggttttagtccacagttcctggcttataactcctatatcccttgttacaatattttcttttttttatataatgttgggtatgttaggcctcaggagcaagcctctgaccttctcctgccttactttcactctaatgtttccccactttctaattgtgacgcttaagactctcacaggagagggttccatcctatatcctgagggaaggaatgctgatgtcatgaagctttcataaaaacccaagaggacagggttcagtgagcttccggatagctgaacatgtggcacttcctggagggtggcgcacccagggagggcatggaagctccgggccccttccttcataccttcccctatggttctcttcatctggatcctttgcaatatcctttataataaaccagtacatgtaagaaaaaaaaaaaaaatgtacttacagtttccttccttccttccttctccttccttccttccttccctccctccctccctccctccctccctccctccctcctttctttctttctttctttcttccttccttccttccttccttccttccttccttcttccttccttccttccttttctttcctctctctctttctgacaaactctcgcactgtcaccaggctggagtgcagtggcatgatcttggctcactgcaactcctacctcctgggttcaagctattctcctgcctcaacctcccaagtagctgtgactataggcacatgccaccaagcccagctaattttttttgtatttttagtagagacggggtttcaccatgttggccaggatggtctcatctcttgaccttgtgatccacctgcctcggcctcccaaagtgctgggattacaggcgtgagccaccatgcctggccaacctacagtattttttctaaggccatctctagctgcatacttaccacactaggtaaattttctgtaaaggcatatgccataaatcaggatttttttgttgtggttttttggtcaagattagtttctacatatcatccagtatttgttacgtctaatgagaggttgtatatatacatgtgaatgtttcaggaccatatggcaattattccatttaaaatattgctgtcctacttctcagaaaaaaggcaaggcataaattattgtttttactattttaaaaaatgtagcccttcatcagagcttagatctataggtataaattactaatgctcatccctttccagtggcaaaaaggagatatcaaattattttgagatttgagtaagaataaaattaataaatagcaagaggacaggtgtgtgaaagttttcatatgagtaacgctcgggttacttatttctttccttttaacaagaattatttagcccttgcctggctcttgctgcagtcaatttgagaggaaaggacatcttgccattgattttaattattcccagtcatcccattccttttttagtagattgaaactctcttgggctggttttctagctccacctacgtattggttggcactgtcttcatttaattttgcctgttattattccttcataatgcctttccctgaagtgacagaacatccttcacctgccaaggtcagcagtttgctacaggagatgacacttccaggatcatatgccaagtctatgtaagggcacaagcgaacggtggtggtaactaatagtcttaaagttatcttgtttattcttatttcagctttcctgctatattttttgcatactctctaaagtaatacatggtaattggaaaaatgtgagaagataaaaaagaaaatcagagagaatgagattgtgtattaattagttatcaccaaacaaaactccagactgtataaataccaaacaaactccagactgtataaaaagtaaaaacaggaaataatcatttcaaaatttcattggattaatgttttctattcctgcattcttccccctccttcttacctcttcctcctcatctttcttcttttccccatgtcaagtaatttccaagatggcccaggaataaagatatgcagttacaaaacattctagccctaactagtaagaacaaatattctctttctgtgaatagaaaggatagatggatctgtatatacacagacttgcatgtgagtttttagaatatgtacatcagttagattgtgttaaggcacaaagccatagagttatgccccacattaggaaatacttccaggaatgtgtattgcatgaataaataaatgaaccaatagcttactatgtgtcagattctttgctgtcctttaaatagatgatcttattgaatcttttccccatattaggaaatacttctaggaataagtattgcatgaataaatgatgaaccaatagcttactatgtgtcagattctttgctgtcctttaaatagatgatcttgttgaaaattcactgtgaaaagaatggggatctagcatgataaaaagatacttgttgactttatggcaggacacaagttacacattttgcagacttaagagaggctgtgtggcctgaattttgaagtagtacctactgctatagtagtgggcactcagattttgtagaattaggcttatcagaaatcctcagtttaattgtacattctatgcacttaatatttgagatttgttacattgtattggtgtctaatattttattcattccctatgagtgccagaaaaggagtgaaggtagagaatatttcatttgtcagtattccatgaaactactgattatgggaaattcatgaaagagcttacagtttaaaattctacaatggattaattaaatatatatatctgattacagctgaagttcaagtccctcagatcaatcagcagtattttcagagataagtagatttatttcttaattaattaattaatatttatgtgtctattaaatatggttcttcattgcacatactttgaaattttttttcttttttagagagagtgtcttgctctgtcacctaggctggagtgcagtggcgcaacctaggctcactgcaacctctgcctcccaggttcaagcaattctcatgcctcagcctccagaatagctgggattacaggcacgtgccaccatgcccagctaagttttatatttttagtagagatggggtttcactgtgttggccaggctggtctcaaactcgcaacttcaggtgatctgcccacctcggcctcccaaagtgctgggattgcaggcatgagccatcacacctggcccatactttgatatttttaaccatcaaattagtgaataaattactgaataaaacttaaccatatctcttccatgggtagggagactatggcatcacaaaggaacagtgttgttatatctttacaataggaaacattggacaaagatggaagagtaaggacaatgttatcattttcattgttccatcatcataatgtgccatgttgtgtatagacttctctacactgtgtggctgcttctttggaatacacagtcctaagcattgctgggattgtgaatgtcaaactactactatagatattttgtatctcagaacttaaacttgatgcagtaattattgtcttaatcattggttttacccttcctatcattgtgttggaataaggtctttcctgaagtgagtactataagcaatagtatagaaatacacaagagacaataaagtacgtgaggaaggctgggcacagtgggtcacacctgtaatcccagcactttgggaggctgaggcgggtagatcacctgaggtcaggagttcaagaccatcctgaccaacatggtgaaaccctgtctctactaaaaatacaaaaattagctgggtgtggtagcatgtgcctgtaatcccagctacttgggaggctgaggcaggagaatcacttgaatttgggaggtggaggttgcagtgagccaagattgtggcattgcactccagcttgggtaacagagtgagacattatgtatatatatatgtgtatataaatatatatgtatgtatgtgaggaggataatagttaatcctaacagattaacttggaatcattcaataagtagactgaactaaaattgggaagccattatttggtattaaattatgggcaccaggggtaaatgactgactaatagagcaggaaacaccagacagagaaaggaatgaaatacaaatgatggtcagtagggaggaggtggtcaaggaaaatgagttatgaacagaaagaactctatttacaggctgacactataaatgcttgtaaatgaaaaataaaattctaaggcctccagtgaactgaatggaaccctcatcttggccaagggtattccaaagttaacctgaaacactagttcaagccatgacgggaatgagtggtcagacatgcctcattataccctcgtcctgttggaattcagtcactactgaccagcattaacattaaaacagagaccttggccggatgcggtggctcacacctgtaatcccagcacccgcctcagcactttgggaggctgaggcgggtggatcacgaggtcaggagttcaagacctgcctggccaagatggtgaaaccccgtctctactaaaaatacaaaaattagccgggcatggtggtgggcacctgtaatcccagctactcgggaggctgaggcagagaattgcttgaacccaggaggcggaggttgcagtgagccaagatcgtgccactgcactccagcctgggtgacagagggagactctgtctcaaaaaaaaaaaaaaaaacagagtccttaagacaacgaagggagacactgtagcaataagagaccaacatagcagacagcaggccctgaagaaaactgaaatattttaccccaagatatatttctttgacatattttgaaatggccctgcaatggtgtctgttgtggggaaaatccatattctgtaaagaattcccttccttttccaagtctttttcctgatccaggagagaattaactaagaatttggcacctttttaagtctgatgagaaatatttacagtgtattctctctgaagcctcccatctggaggctttatctgcataataaaagccttgatctccacaacaaccgcttttcttaacccagacactcccttctattgattccacgcctttagataaactcttcaactgtgaatccacctatgacctgaaatcccactccccacaagccctcccaaccaagttgagttgtcccacctttccagaccaaaccaatatacatcttacatgtattgattgatgttttatgtctccttaaaatgtataaaaccaagctgtagctgaccaccttgggcacatgttctcaggactcctaaggttgtgtcacgggtatgtttttgaccttggcaaaataaacttctaaattgtttgggaactgtctcaaataccctttgggttactccctgaactatgccagaaaatcattgacattgtgaagggaaaatatcttgggtcccccaaatcactaagctaaagggaaaagttaaggttgggaacctcttagggaaacctgcctcccactctattcagtcacccctcttctcactgagataagcgcatatctgattgcctcctttggagaggctgatcacaaactcaaaagaatgcaaccatttgtctcttatctacttatgacctggaagccccctccaagcttccagttgtcctgcctttccagaccgaaatgatgttcatcttacatatgttgattgatgtctcatgtctccctgaaatgtataaatccaaactgctctgactgccttgggacatgtcatcagaacttcctgaggctgtcatgggctcacatcctcaaccatggcaaaataagctttctgaattaactgagacctgtctcataatttgggggttcatgttttggtaaccacagagggattctaagtagaggtgcccctgacctttgacaaatctccttttggtgtttggtatcagcttgagctatctttatggctcaaaccaataggataatttgctgaggtctggaagcaccctctccagagaatccctgatcttccaaaatttggttgagatctacagtttattttggtacgtaactcctttttttgaattttacttgcttccaacccaaggaaggcaagttttccctgcttccataatgatggaaggcagataactcctttatggagtttgagctcacttccaacagggaagatgagtttttgttgttgtttgtttatttgttttgagacagagtcttgctctgtcacccaggctggagtgcagtggcacgatctcagctcactgcaatctctgcctcctgggttcaagtgattctcctacctcagcctcctgagtagctgggactataggcgttcaccaccatgcccagctaattttttatttttagtagagacagggtttcaacatgttggttaggctggtcttgaactactaacctcaagtgatctgcctgccctggcctcccaaaatgctggggttaccggtgtgagccaccgcacccagcctgatgagatcccctccgctgccccctacttctaggatggtagagagcagccttcagcctgaaatccatccctaggcaagtaaatgatgtcaggcctctgagcccaagctaagccatcgtatcccctgtgacttgcacatacacatcccggtggccggttcctgccttaactgatgacattccaccacaaaagaagtgaaaatggcctgtttctgccttaactgatgacattgtcttgtgaaattccttatcctggctcaaaagctcccctactgagcaccttgtgatcccccactctgcccgccagcgaacaacccccctttgactgtaattttcctttatctacccaaatcctataaaacggtcccacccttatctcccttcgctgactctcttttcagactcagcccgcctgcacccaggtgaaataaacagccatgttgctcacacaaagcctgtttggtggtctcttcacacggatgcacatgaaaaatgaagtggggtttgtcttggttaaagttaagatttccaaccgcctgatcttaatttctccttaccattagagtgcttggtaatcatgtaagttgtgcaattgtttgttttgcttaacttttgttttgttattgttttttgtttctggtttttgttgttgtttcagtctttttctcattgggtttgatcaactctatccaactagatcaaatccaaaggaagttccaaattatggaacaaggcctctgaagtggctaaattcccagaaaaacgacgacaacaacaacagcaacaacaactacaaaaacggtggtgtggtagcagagaaatataccagcaaaaggaaaaaaaagaggaaaggctttgattttgactactaataggctttatttacatagcaaggtggcctttttgctaatcaggccaaactgaaagagcaatggctattacttctgaaatagcagcaatttgtcctagctgaaatatggtaatgatatttaaaaacatattttttaaaggggctcagtggctagtcagcttaattaaaagctaacatccaagatgtgtgtgtgtatgtgtgcatatgtgtgtgtttgtatttaaaagaccctcatgcttttgtttttgcttttctcctaggaccttgtctctttttcgagcaaaagttttttcttctcagttgactgaattctgttttcttcacttgtttgtttctgctctctctcctttctcttgcaccctctgctgcatggggaacctaaaatagttcgtaatagcctggggttccttaaagaaaacagtgaaggcaccagactcccttcggaggagaaacctgtttttccttatggaaccccaagaatgcaaacagacaaggtcctctcagctcttaaactgcttactttttttcactcacgtccgtgtgaagagaccaccaaacaggctttgtgtgagcaacaaggctgtttatttcacctgggtgcaggtgggctgagtccgaaaagagtcagcgaaggcagataggggtggggccgttttataagatttgggtaggtaaaggaaaaagggaggttgttctctggcgggcaggggtgggggtcacaaagtgctcagcgggggagcttttgagccaggaggagccaggagaaggaatttcacaaggtaatgtcatcagttaaggcaggaacaggccattttcacttcttttgtggtggaatgtcatcagttaaggcaggaaccagccatctggatgtgtatgtgcaggtcacaggggatatgatgtcttagcttgggctcagaggcctgacacttttgtattgtgttacctggttttttgtttttgtttttggctaacatagttattgcaacagagtttgctcttgggtttttaaggaagagtgtgttttagacactagaaatgtctttgcttaaaaaaaatttttctaagtgcacttaaaaaaacttaaaaaagtatcatgtggtctaaccttattataattctcccattctggagaccctggaatcagtgtgggctctgcccacagctcagggatccagttaaaagataggtagttcctatctaaataaaactggtctccttatccaatcttacgatagatttctgtaattttatgtttgatttggcatctatctttaatctccctctagcatcaccagactttttctctcagtaccttgtgatgtaaattttgctatttgcatttcacctgagtcgtttcctttaatttgcaaatttaagcgtgtttacctgacaactgcctagggttgtgaaacagattatcaaaaatctgaaagtctaagatagggaaaaaaaggtttttataaatctataagatgtaatttatcagcatgcctaatatgtctatgtatttatatgttatgtacagaatgtttcactactcaaaatagataaaagagctctaattaattggcttaagaaaacaaaaatgcttgaatcaaatactttattggaaaaaagaaaagactagtcaaatgcttattcaagtttatgtaacttaagtaaaatctttaataaataagctagctttaaaattattggtaaagtaatattagaaatgtcttaagaattgccagcatacatttttgttttgtatttattaatcaagcaatttcatacttatccctgtcaaatgctatgaggtgtcaaaatttggcatagtggttacaaaactataaaaccagcccaagaaaatgatctttccctgtgtaatctttaaataaattagagattgatattggtgtaataagctacatcattttattttatttatttatttatttgtgtttttttgagacagtcttgctctgtcaccgaggctggagtgcagtggcacgatctcggctcactgcaacctccacctcccaagttcaagtgattctcctgcctcagcctgagcctcctgcctcagtccggagtagctgggactacaggcgcatgccaccacacggagctaattttttgtagttttagtagagatggggtttcaccttgttagccagggtgatctcaatatccttacttcgtgatccgcccacctcggtcttccaaagtgctgggattacagtcatgaaccaccatgccctgcctttatttactttttttgagactgagtctcactctgtcaccgaggctgtagtgcagtggcatgatctcagctcactgcaacctctgcctcttgggttcaagtgattctcatgcctcagcctcccaagtagctgggattacaggcatgtgccgccgttcccagataatttttgtattttttgtatagacagggtttcgccatgttagccaggctggactcaaactcctgggctcatatgatttgcccgcttcagcctcccaaagtgctgggattataagcaggagccaccaagccctgccaacatcttgaatttagtaagattactgtgacttctaatcttgtggcttttgtcggtctagtccacaggcagtaaggtttgttttgggaaaggactgttatcatctttctttcaaagctaaactataaactaagttcttcccaaagttagttcaaacttttatcaaagccaatttaaaagcctatgtaaaaaaataattattcttgctgagctgtatacaaataatttggccaagtatcataaagcaaatgaatcctatcatgatttgtcttgagtaaaaattaaaaactggagagagaataactgtgtttcaaaacctatactatacctgttgttagattctaggtcttgcctaatgtttttcaatttttattattttctacagtttggaccaaattctaatttttcttggctacaagtcttcaaaataatgttctcatttttttcttcttttttttccccacttttcctaatttggagtcactgaaaactaagctgtgctttcgtaaagccctgtgaactgaagctagacaactcgaacttcagaagaaaataacagcaacctatttacatacataagccactttcctacctgcctccaatgtaaggatttcagagtaatgtggcctatatcaattttccaggattgttcttttgcttattgttgtttttctcccttcctccccctattttatctttaaaggatatgaagcttcacaacttctaaaaaatgagctttcctaataactcaggacctatctgcctaggaataacccattgtacccatgagaaattagaggaaatctgagatcagagactcattttcttttaacatgttttctccaaagattttaaaaaagaaaaggggggaaatgtgagagaaaaatatcctgcccccccaaggttactaaactaaagggaaaagtcaagctgggaactgcttagggcaaacttgcctcccattctattcaaagtcaccccttgctcactgagataaatgcaaatctgattgtctcctttggagaggctaattagaaactcagaagaatgcaaccatttgtctcttatctatgtatgacccggaagtcccctccaagcttccagttgtcctgcctttccagaatgaaacaatgttcatcttacctatgttgattgatgtctcatgtctccctgaaatgtataaaaccaaactgtgctctgaccaccttgggcacatgtcatcaggacctcctgagactgtgtcacgggagcaagtcctcagcactggcaaacttactaaattgactgagacctgtcttagatttttggggttcacaacattcattagcgattgggggtctaggactgaaatttaaaggcatagatgaagtctgacagatccaatctgatgttaactttgggattttctttagttaccactcagtgccccagtcctccttaaaatactttatacctccaagtctctttccttccataaaagccaattgtttctctaacactaggtctctgccttgctgttacctgccttcagaacctggggtcttcccttcatagttagggttcccaccagctaagaattcacggcctggatctctgcatattgcctatgctcagattgccttgctgccatgtcccacctatcctgtcacacttttctcacctggagtttgatggtttccttgtcactcttcctcccttgcagtgtgctctactttgcttctctgggcagacccttgcataatcctgggtctgcccctatatgcctctagtaggagttgatgctgggcttgtattttggatagtcccaatggtaaataaaccctgactgtcgttcattcatctgtcaaatatcattatgctctaccatgtattaagcattatgctaggcacttgagatataatgagagaaataaccatggaggaacacaggaactctcatacattgctgcaatttggcagtatattgtaaagttgaacaggtacatgccctactctgcagctaattaatgtctcggtatctacctataaagactcttgtttctcctcatttacttcatttgcttttctttcatttacaacatattatgtaggacatactttttttttttttttttttttttttgagatggagtctctctctgtccctcaggctggagtgcagtggagcaatctgggcttactgtaaccgctacctcctgagctcaagtaaggtggaggttgcagtgagcccagatcctcctgcctcagccttctgagtagctgggattataggcacatgccaccaagcctggctccggtacatgacttcaggtgatcctgacctcagatgacccacccacctcggcctcccaaagtgctgggattacaggcatgagtcactgtgtctggctgagcatgcaaaatttgtaatcggtagacattgtttataggcatgtttcataattataaaatgaattaaaaatcagtcacataaatatatgggctttttcaaaataacccaacatggaaaccttgatatccttccctagatctatggcagtctttgtagtctccatgacattgcacagcttgggttcagaaatgactctctagaaaaactgaaacaccacacctctgtagataatgatgtgcagctggggctcagccacttgtgttagtgaagttcctttcacaccaaagatactcaccccacttccatattatatccaatcatagtatttcaacttctgtcaaaattcccagtctccaactatggtgcagcagatcctttcaaatgtaaatacaatagcataaacttatatactgacaattctgtaacatacagaatttcattctgtatgattctatttaatagagtttcaaaatattcatatggatgaccataaaagaaagtaagattaaagatgtgctctttatgaaaaggtgtaacccacatttcaatcagggatactttataatctttaaaaaacacaccattgaccaggtgcggtgactcatgcctgtaatcccagcactgtgggaggctgaggcaggtgaatcacctgaggtcaggagttcaagaccagcctggccaacatggtgaaaccccatctccactaaaaatacaaaaatgctagccaggcatggtggcaggtgcctgtaattccagctaccagggaggctgaggcaggagaatcacttgaacctaggaggcggaggctgcagtgagccaagattgcaccactgcactccaggctgggtgacagagtgagactctgtctcaaaacaaacaatcaaacagccacaccatcggccaggcgcagtggctcatgcctgtaatcccagtactttggaggttgaggtgggcagatcccttgaggccaggagtttgagatcagcctgggcaacatggtgaaacccagtctctactgaaaatacaaaaattagccgggcatgatggtgcatgcctgtaacccagctactagggaggctgaggcacaagaatcacttgaacctgggaagtggaggttgcactgagccgaacttgcgccactgcactccagtctgggcaacagagatagacgctgtctcaaaaaaacccaaaaaaccaaaaacaaacaaacatacaaacaaaaaacaccattgtttttatttgtattttttccctatttactacttccacaggaaaattgtttgatttttgctctattttaagccaaacttcatatgcagggtaaggctgaggcaaaacaagtgagaaagtggttgtagataaatgtaaacgaatgaccatgagatgaccctttcagaacttgtgcaacacgtatgtcaccagccccattagcctgtgttaggaataacgttcaaaatcctaaggaaattgaacactcgaacaaaggattcttagcaaagcaattttacttctgcgcacaggggtgcctccttggccagttacatgagagcacacctgaacaaaggggcaggggaacctttatttctgtcgcaagtcctgccccgtacgctttttttattggccagggtcgggtcgtacaatttaaactaatctcggttggctaagcatttgattttttttagatagggtgggcacgtacaagaaagtggagaggaaggctggacgcggtggctcacgcctgtaatcccagcactttgggaggccgaggcgggcagaacacgaggtcaggagattgagaccatcctggctaacacggtgaaacctcgtctctactaaaaatacaaaaaaattagtcgggcgcctgtagtcccagctactagggaggcggaggcaggagaatgacgtgaacccaggaggcggagcttgcagcgagccaagattgcgccactgcactctagcctgggggacagagggagactccgtctaaaaaaaaaaaaaaaaaaaaaaaaaaaaataaaggaagtggagaggaaggggaagggttgtctgcaatgagctagaaagttagtctttttttttttttttaaataaggaaaggaatgcgaggtggtactgataatgcctggtactgtagcgtgcctgggcattaaaggagaaaaacggaaaaacggcgggggtactatgaattaaagaataaaagattgatcagattatttgaagagaaaccgcatcatatcccacacctgtcactacataatgaggttatgcttcatttttatatgtatataattatgaaaaaagactctgtctgtttgcttaccagatgttagcatgtatttttctacaacattgtttggagcgtttcctagagtactgcttggctttttgttcaggagccttgctgcagctgggtccttccttgcagccttcccaccctgctgactgacaggatgctacctttattgctgctgatgtttatcagactgatactctgcctctaattgcaactggcattgtctctccagctcacaggaggggaaactgttcttgtaattcttcgtaatacagttgaggcccggctaggaccttggccaggcttgggagtcatagggtttgcaaactcaaatgtcaacagaagtctggctggtaatggaagcgtgaaggctgcatagtttaagaaatgtgggcatgccatttggctttaatgttaggaaataacagccagtggccaggcgcagtggctcacgactgtaaccccagcgttttgggaggccgagatgggcggatcacgaagtcaggagatcgagatcatcctggctaacatggtgaaaccccgtctctactaaaaatacaaaaaaattagctgggcatggtggcaggcacctgtagtcccagctactcgggaggctgaggcaggagaatggcgtggacccgggaggcggagcttgcagtgagctgagatcacgccactgcactccagcctaggcgacagagcgaggctccgtctcaaaaaaaaaaaaaaaagaaaaaaaaagaaaagaaaagaaaagaaataacagccagtatgagtgaactgacgacgacatactgcatttaaagggagaagctgctattcaaagccaactgattgttgatatatggaaacagggcttagtttttccagttacgattttgcaaaagaactctgcaatttatattttttaagggaaatattcttatttttcaatactggcaactaattctttttttttttttttttaaagaaagtgctgtggccaaaccaaatatttctgtgggcctccatagaactatgaaacactaatctatgaccattgactaacaactgctaccggaagtagttacttgctactcccaggactcacagtccaactatcttttagattccctgcatagcaaccggcagacctccatgtagcatgagctgacacagacagacatacagacatacacacacacacatgcacacgcacatttacagagtgcatatgaatgaaaatcccatttatatcaggagaaaaacccacatcctccccaatattggtgttgggctccacagactactcaaagccatcactgtggtttgcccatttagtctcaaataacactttatgtggaagagaaatgttacattatagtccatatgccactgcgtcaaatccaatgcactttgcattcaatcttgccttcaggatgaggtaaagaaaagttgctactgtatgcatggcataatctcatctcctatctcctggaagcaaatggttaaacaaaaattataaacacaacttccaagaacaaaatagtaattttcagtagcaagtagcctgaattcagatttaagataaactatgtctaactctgtggaggttcagcctggctaataaatcaaatttacattaaggtcagggctctggtgggactattcccttatattcaggagtgtcttcaagaataatggaaagctacttgagtacaagagtaaaagggcccactcaatttccacatcagaatgcgggaaaaccacatgccatattctcattggaaacttctcctgcttcaaaatttaaagttcattctgcaccagataatccatttgattaaaagaaaacaacttctgagggctaacctgttaaataagcccacatccaaagtcatcttaaaggtgactatcagagcaataaaatgaaacagtaaccctgcttgaaggcaaaacaaatttgaagaacaattcagccagaggtagagtcttgaagtctaacaccagctgtaagaaatgaacactatgctggagaagaggtgagagatcaggctaccttgtttttgagtaacctagcatgtagatatctattgtgcaggaagatgtatcaggtaccttggaattacagaactaatgtctatggtgctgaatttatgctaagaaatattctgataatttaattttcccattaagaaaaagtttgctggtcaacctgaaaaatatggtctatttggccagattgacaatatttctcattataaattaacaaataagttttctggttatatactttagttacacaaatatattgtgtaattgtatgatatgattacattgagagggtctaaatattttatatacttaagaaatattaggtaagttgattttaaataggcattacagatggcaacataagtaaattaaaatatcaccttatacagtcaactcatttttaacttttctttattcatgcactggaaacatgcatttttatttttatttctcaaactattttttaagattaaatgaattcatttttctttacctgcagaaaattgccctgtcattaagaaagaggaagaagagaacattcatatttattgacagcattgtttggcctcttatatatataaaatgtcatttgttttgcacaataaccctggggaaaaaaggtattctccctgtgtaataaaaataggttgaggcatgtttagtaaaacatgccctaggtcacacagctagtaaattgtgggctaagatgactcttttattctttatgatttttttattggcacattgtagcctaaaattctaaaagaacatataatcttgtgtgctactaaaaattttaatctgctctacccaaggtttaagtagtatttgaatgagccagattgggagaggccgtgactcagtcagagtcagactgtcagacttgcagtgttgtttggaaagatgggtttctgagatgggcattaggccagggacatcaggcttcaagtaaatctaaaatctaggagattattctttgtagggtagaggagacgcaaaggacataggcttaaaataagcatattaacctgtgcagctgcattaatgagtgcggcttcaaaagaatctcttcagtaacagagaaaataatgactatattcatacatagtaggccattgacagaagacccaggaataagatcagccatatattgtatctgaaatatggctaaagtgtaattaaatatttaatattaaactaaactcatatagaactgggaaataagaccatcaaattctcagttattgttatctctgaaagtggctttgtttagttgataatttgactagggttagaattataggtccaaatatatacatatatatatatacacacacacacgtatatatatatatatatatatatatataccgtgtatatatatatatatatatatataccgtgtatatatatatatatatatatatacactttttttccaactcaatattttgctcaagtgtttaattgcaagtagtatgctgatgaaaaatctgttgttaatcttgttcttattttcctgtaaggaatctttcttttctctctagcagtgtcagaaatttcctttttatacttagtattctaagatttcaccatcttgtacctgtctttttaattttgcatggctttcactgacccattatgtagtttcatgtctttataaagttctggacaattttaggctattacctcctgaaatattttttccctacattctgtctaaatctattgaaaagagttacgagtgggtaggtaatttggtgactggtctcttggtatgacagcatctcattccttttggtgtcaccaactctctaatacactgccctatttctctgcaataagaactgtattcatctttcctttgtggagatagatattgctatttgtcttataggagggagaggagagagatactcaggggctgacctgtctgggttctccctttgtggggctccaactaatcatcctgccaatggcttttgggtacccctcctgctcctggatttcattccttccaggcatggagcatttatcttgttggtctcacctcctgggttagaacttttctgaaggaatcatgggctgtgacctctttcttttctgctcatatttttcaaagactaattattatttctgtcgttttcaccatagatatttttatttatttaaaaaataaattttccttaatttttatgaatttagtgtaagaggagggattatattaaatgctcaccattttaaaattagaagtctgtcttctatctttccttcactaatatgtgtgttttgtacttagtcatatggtcaaatacttgtacataaaattatctgaaaaagcaaatgaaaaattaactagatttccccgtcgtatttgcatgtattccttacaaacttacctcagtcttcattttttcctgctctgtccattttcatccaaaacatacacatatacatcatacagtcaagataagcatgcatatatcacaggtatctttaacacagtttgaagatgtaacccttcattaaatgatgatggagaaaaaataaaggtaaacttagagggtatagttgagagacagtattaaaacaattgacttttaaccttattggtcttgattatggaacggagatgggtgaatcgttcatttagatttttttttttttttttgagacagagtttcactcttgttgcccaggctggagtgcaatggcacaatctcagctcactgcaacctccgcctccctggttcaagtgattatcttacctcagcctcctgagtagctgggattacaggcatgcaccaccacgcccaactaatttttgtatttttagtagggacggggtttcaccatgttggccaggatggtctcaatctcttgacctcgtgatccacctgccttggcctcccaaagttctgggattacaggtgtgagtcactgcacctggcctcatttagagtttatgttatttatttatagcttgataatattttatcttttaatttttattattgtctaaatattcagatttagaggaaatattattttcttcaggcaaaataacagtcctgagaggcaaagtttttttgcttcttttttttgagatgcagtttcactcttgtcatccaggctggagtgcaacggtgcgatctcggctcactgcaacctttacctcctggattcaagcgattctcctacctaggctcccaagtagctgggactacaggcacacaccaccatgcctggctaatgtttttttttttttttttttttttagtagagatggggttcgagaccatgttggccaggctggtctcgaactcctgacctcaggtgatccacccgcctcagcctcccaaagtgctgggattacaggcatgagccgccacacccagcctgcttttaaaaatattatttttaagttattagtagaatggacttattgaaatatgtactttttaactgaaggtacttggcatagtaagtttaactatgtttaactctgttgatttgcttttacattttgtgcaatcataagtgtccttcagttcttaaatatccacagcaaatcaaatattaactctgtgcatgtttttgagtttttattaagtagtgtttatatcattgtacctattcttatagctattgcctacatccaagtaggcattttgtttagttctttttctttagtctctcgaaataatgaaaagtgaaaatttctataatttgattgactgttttaagtctttaagtatattacactttgggcaaaatgcctactactgataaagacagcaaagtttttacagatgtataattaaaaactgacaatgcagtataatggagaacacacagaaagttccctttgtagtagtaaaaatgttggtatgcatagaggtgggaacttcaatgtgctagtgtggagggagtggtgtggaagtggtatgccataagtgtggaaaggtaggtaggaaccggatctttcctggccttataggttataataaggatattagatctttttctcaagccaataaggaattttaaaataactttaaagaggggaatggcatgattagtctatagttttaaaaagtcactctgccttcattatgggaaatacattgggggcagagggtatacaaatgcacatagggaggaggatgtgcattgaaacatatacatttgtgggcacaaaataaatattttgggatattggcagattggctaactctattctcttcagacttcttttcaatattttctgaaacgtcaccatggacaaataataattaataattaataattcattaattaatcattaatacaggaggttccaagatggccgaataggaacagctccagactgcagctcccagaagatgggttatttctgcattttcaactgaggtaccaggttcatctcaatggggcttgtcagacagcgggtgcagcccagggtgcagggcggggcatcgcctcacccaggaagcgcaaggggtcagggaattccccttcctagcaaagagaagccatgacagacagtacctggaaaatcaggacactcccaccctaatactgtgcttttccaatggccttggcaaacagcacaccaggagattatatcctgcacctggcttggagggtcccttgctcactgctagcacagcagtctgagatcaaactgcaaggcggcagcaaggctgggggaggggcgtccgccattgctgaagcttgagtaggtaaacaaagcggccgggaagctcgaactgggtggagcctaccacagctcaaggaggcctgcctgcctctgtatactctacctctgcgggcagggcatagctgaacaaaaggcagcagaaacttctgcagacttaaatgtccctatctgacagttttgaagagagtagtgcttctcccagcatggagtttgagatctgagaatggacagactgcctcctcaaatgggtccccgacctccaagtagcctaactgggagactcctcccagtatgggctgactgacacctcatacagccaggtatccctctgagatgaagcttccagaggaaggatcaggcagcaacatttgccattctgcaatatttgctgttctgcagcctctgctgggatacccaggcaaacagggtctggaatggacctccagcaaattccaacagacctgcagctgagggtcctgactgttagaaggaaaactaacaaacagaaaggacatccacaccaaaaccccatctgtaggtcaccatgatcaaagaccaaaggtagataaagccacaaagatggggagaaaccagagcagaaaagctgaaaattctaaaaatcagagcacctcttctccaaaggaatgcagctcctcaccagcaatagaataaaactggatggagaatgactttgacgagttgaaagaagacggcttcagacgattggtaataacaaacttctccaagctacaggaggatgttcaaacccattgcaaagaagctaaaaaccttgaaaaaagactagacaaatggctaactagaataaacagtgtagagaagtccttaaaggacctgatggagctgaaaaccatggcacgagaagtatgtgacgcatgcacaagcttcagtagccgattcgatcaactggaagaaggggtatcagtgattgaagatcaaatgaatgaaatgcagtgagaagagaagtttagagaaaaaagagtaaaaagaaatgaacaaagcctccaagaaatatgggattatgtgaaaagaccaaatctacgtctgaatggtgtacctgaaagtgacggggagaatggaaccaagttggaaaacactctgcaggacattatccaggagaatttccccaacctagcaaggcaagccaacattcaaattcaggaaatacagagaatgtcacagagatactcctcaagaagagcaactccaagacacataattgtcagattcaccaaaatagaaatgaaggaaaaaatgttaagggcaggcagagagaaagattgggttacccacaaagggaagcccatcagactaacagcggatctctcagcagaatctctataagccagaagagagtgggggccaatattcaacattcttaaagaaaagaattttcagcctagaatttcatatccagccaaactaagcttcgtaagtggaatggcacaatctcatgcgccaaacaaatgctgacagattttgtcaccaccaggcctgccttgcaagagctcctgcaggaagcactaaacatggaaaggaacaactggtaccagtcactgcaaaaacatgccaaattgtaaagaccattgaggctaggaagaaactgcatcaactaacaagcaaaataaccagctaacatcatgacaggatccaattcacacataacaatattaaccttaaatgtaaatgggctaaatgctccaatgaaaagacacagactggcaaattggataaagagtcaagacccaacagtgtgctgtatttaggagacccgtctcacatgcagagacacacataggctcaaaataaagggatggacaaagatctaccaagcaaatagaaaacaggggttgcaaaaaagcaggggttgcaatcctagtctctgataaaactgactttaaaccaacaaagatcaaaagagacaaagaaggccattacgtattggtaaagggatcaattcaacaagaagagctaactatcctaaatatatatgcacccaatataggagcacccagattcacaaagcaagtccttagagaactacaaagagacttagactcccacacaataataaagggagactttaacactccactgtcaacattagacagatcgagacagaaagttaacaaggatatccaggaattgaactcagctctgcaccaagcagacctaatagacatctacagaattctccacctcaaatcaacagaatatacattcttctcagcaccacatcccacttattccaaaactgatcacatagttggaagtaaagcactccttagcaaatgtaaaagaacagaaattataacaaactgtctctcagaccacagttcaatcaaactagaactcaggattaacaaactcactcaaaaccgctcaactgcacggaaactgaacaacctgctcctgaatgactactgggtacataacaaaatgaaggcagaaataaagatgttctttgaaaccagtgagaacaaagacacaacataccagaatctctgggacacatttaaagcagtgtgtagagggaaatttatagcactaaatgcccataagagaaagcaggaaagatccaaaattgacaccctaacatcacagttaaaagaactagaaaagcaagagcaaacatattcaaaagttagcagaaggcaagaaataactaagatcagagcagaactgaaggagctagagacacaaaaaaacccttcaaaaaatcaatgaatccaggagctggttttttgagaagatcaacaaaattgatagactgctagtaagattaataaagaagaaaggggagaagaatcaaatagatgcaataaaaaatgagaaagaggatatcaccaccaatcccacagaaatacaaactaccatcagagaatactataaacacctctatgcaaataaactagaaaatctggaagaaatgtataagttcctggacacatacgccctcccaagactaaaccagtaacaagttgaatccctgaatacaccaataaaaggctctgaaattgaggcaataattaatagcttaccaaccaagaaaaatccaggaccacatggattcacagccaaattctaccagaggtacaaagaggagatggtactattccttctgaaactttcccaatcaatagaaaaagagggaatcctccctaattcattttatgaggccaacatcatcctgataccaaagcctggcagagacacaacaaaaaaagagaattttagaccaatatccctgatgaacatcgatgcaaaaatcctcaataaaatactggcaaacccaatccagcagcacatcaaaaagcttatccaccatgatcaagtgggcttcatccctgggatgcaaggctggttcaacataagcaaatcaataaatgtaatccatcatattaacagaaccaaagacaacaaccacatgattatctcaatagatgcagaaaaggcctttgacaaaattcaacagcccttcatgctaaaaactctcaataaactaggtattgatgacaagtatctcaaaataataagagctatttatgacaaatccacagccactatcatactgaatgggcaaaaactggaagcattccctttgaaaatcagcacaagacagggatgcctccctcaccactcctattaaacatatcattggaagttctggccagggcaatcaggcaagagaaagaaataaagagtattcaattagacaaagaggaagtcaaattgtccctgtttgcagatgacatgatcatatatttagaaaaccccatcatctcagcccaaaatctctttaagcgataagcaacttcagcaaattctcgggttacaaattcaatgtgcaaaaatcacaaggattcctatacaccaataatagacaaacagagaggcaagtcatgagtgaactcccattcacaattgcttcaaagacaataaaataccaaggaatccaacttacaagggatgtgaaggacctcttcaaggagaactacaaaccactgttcaacgaaataaaagaggacacaaacaaatggaagaaaattccatgctcatggataggaagaatcaatattttgaaaatggccatactgcccaaggtaatttatagattcaatgccatccccatcaagctaccaatgactttcttcacagaattggaaaaacctactttaaagttcatgtggaaccaaaaaagagcccacattgccaagtcagtcctaagccaaaagaacaaagctggaggcatcatactacctgacttcaaactatactacaaggctacagtaaccaaaacagcatggtactggtaccaaaacagagatatagaccaatggaacagaatagagcccccggaaataataccacacatctagaaccatctgatctttgacaaacctgacaaaaacaagaaatggggaaaggattccctatttaataaatggtgctgggaaaactggctagccatatgtagaaagctgaaactggatcccttccttatactttatacaaaaattaattcaagatggattaaagacttaaatgttagacctaaaaccataaaaaccctagaagaaaacctaggcaataccattcagggcataggcatgggcaatgacttcatgattaaagcaccaaaagcaagggcaacaaaagccaaaattgacaaatgggatctaattaaactaaagggcttctgcacagcaaaagaaactaccatcagagtgaacaggcaacctacagaatgggaggaaatttttgcaatctacccatctgacaaagggctaatatccagaatctacaaagaacttaaacaaatttacaagaaaaaaaacaaacaactccatcaaaaaatgggcaaaggatatgaacagacaattctcaaaagaagacatttatgcagccaacagacacatgaaaaagtgctcatcgtcactggccatcagagaaatggaaatcaaaaccacaatgagataccatctcacaccagttagaacagcgatcattaaaaagtcaagaaacaacaggtgctggagaggatgtggagaaataggaatgcttttacactattggtgggagtgtaaactagttcagtcattgtggaagacagtgtggtgattcctcagggatctagaactagaaataccatttgatccagccatcccattactgggcatatacgtaaaggaatataaatcatgctgctataaggacacatgcacaagtttgtttattatggcactattcacaatagcaaagacttggaaccaacccaaatgtccatcaatgatagactggattaagaaaatgtggcacatatacaccatggaatactatgcagccataaataaggatgagttcatgtcctttgtaggtacatggatgaagctggaaaccatcattctgagcaaactatcgcaaggagagaaaaccaaacaccgcatgttctcactcataggtgggaattgaacaatgagaacagctggacacagggcggggagcatcacacattggggcctgtcatggggttggggaagcagggagggatagcattaggagagatacctaatgtaaacgatgaattaacaggtgcagcacaccaacatggcacttgtatacatatgtaacaacctgcccgttgtgcaaatgtaccctagaagttaaagtataaaaaaaaaaaaaagaacaagaactccaataacaggccttgaaaaactaagcgtgaaatccaggttgtggaacgtttgaccccaggaagaatgtatttcatctgtgtgtagttcatctgtattcttgtggtaatcaagcagacaccagctagaccactagttggcccactgctcaagacagtcgtcaagaccagacatactaccgcacacgtagtcaactcctgtgcttcccataaaaaccgtctagctagcctgagaaacttgagatgatctttgtgacatgagtccaccatctcctctggttgtcaactcctgaataaacccatttttctccctcaaaaaacattaataattattaataataaattaacaataaatcattaacaataattaataattaataataattaataataaaaattaataaaaataaaataaaataaaagtattaaaaactctaataaaatataatacaatataatatataatacaatacaacataatatgtgttatggctaaggaaatttcagattaggaaggacacctaatttagactaaaagagaacagcttcctagagaaggtgaaagatgagttaagtgctgatagctggatagttcagtcagaccaagaaagaatggcttttctgaatcaaagaagaacatttatgtggatatcctgataaaacggaaaacagatcagagtacaaagtataccattaccagggatgtggctgaagagataggccgacaagatattagatattatgctaaaaatccaggatttatcctgaaatggtgaatggtaattgaaagatttttagcaagacagtgacatgatgaaactggtatttcaaaatgaacatgctagcaagaggtgggataatgtactggatgagaataagacgggaagcagagaggcccattaggaatttgattcatttattcactaatggtgataccaaatgcttagtatgtaacaactattgagccaggtgttagggacacagtggtcaacaaaaaagagggccactgctttccttcaaaggtttaaaatctagcacatcaataaaataatacagggaggtaatccagcgcttgaccattctctccctttaaaaattatgtgtgttactttattataatttaaaaatacagatgaataagaagaatgtgaacaaaatcagacatccactcaacctctatggaatgttaacattttattgtgtgtacatacttctagatgtttaaaaatatagtatgtgtatatattgtatatcatacaattatatgaataaatcagactgttctcaattggtttatgatctagtttcctcttaacaacacatggtgatctttccataaccataaatctatttatccatattattttttatgaggggatgatgttctactgcattttcggacattttaggtaggactattcaaaacaatgttagaatgaatattcttataggcaagttttaaatttcatttcattagattaaattcttagaagtggaataaaagaaaatgcacattttaaaggcctttgataatgccccaaaccctcctttataatcttttcttctggcttccataccatactttgttaggttttttttttttttttaactacatcagcaactcatacacagtcttcttcattagttcattgctgcacattgaaatcatctggggatttttaaaaattactgatgcctggctcccacccttagacataccaatttcattggtatgtggtacaatctgggaattggaatttttagaagtgcctcaagtgattcttacttgcagcaaaagatagaaaccactgtattcttttattttccctgtttactacagaaatttaagttccatcctagatctgcatcttaccttttttcacatgctcttcatatgtaatcataatttcacctcttccactctaaactctatgaatataattaaaaactcgtatcttgcacttttcctgaggtccagttccactttgttcattgcctataggaaagtgtgcactaatgctaaatatagaattagctctcaaacttggtgtatctcaaactgaattaagaggtctcccttactcttgataaacagaaaactaaacacatgtttaaaaaaacagcaacacctgtggggaaagatattttctacctttcagttggttgcaaagctcttgtcttgattctttctctaaaacatattttaaatcagtttcccctaccctttctattaccattaccacaacctctaccctcagagtagtaccactgtgacaatacttatctgaatatctgtcttgggagcactggcctgtcagagtagtttgcctgcaatctcacttgcatgaagatagcacctagtgaataccagtagatatgacattagggactgaaatcaaggtggaattaaaaatttcaacacatgtaagtaagagtgtgtgtgtgtgggaggaagtgggataatgtaggagaagggacagtgatcatttccaactacttgaagatggccactcttgggccaggaactcagcccagggttggagaatgttgagatacatcgggctcatcccgattgatttcaggctgcaaaggtcactttgagaattaattgacccaataatggaggaacaactataacgttccaggagaaagaaggctaaaaagcaaaactattttatttgtgttataaatatctgaatttttaaaaaatttgaactccttacccaggcaagtctgccataatttcaaccaaggaatactgacaaatctagaaattgagagatttataagctactgaatctaaaatatggaagcagctaagctgacatgactggggaaagtgaggatcctttaatctctgactgtgagggtgactgtccttgacatgctgtgaagagtagctataaaccatcacttcttgtttctcagatctcaaactattgatccactcagctaaaataaaagctccattgagcagaggccttgattgtacaattaattattctccagcagctctgagagtgtgagatatatggtagccatacaaaaaatattgagttaataatttctcatactggggccaaaacccctgtgaccatagtagcaatgtagtagggtgttcaagtgtgttacttctttagaattttagaaatgtaatttaagaattttttttttttttttttttgagactgaatctcactttgtttcccaggctggagtgcggtggctcgattctggctcactgcaacctccgtctcctgggttcaagtgatttgcctgcctcagcctcccgagtagttgggattacaggcgtgcgccaccatgcccagctaattttgtatatttagtagagatggggtttcacatgttagccaggctgatctctaactgctgacctctggtgatctgcccgcctcagtctcccaaagtgctgggattaacaggcgtgagccaccactcctggcctaagatcattttaataagatttaagagacactaatttctgtctttcaagagaggtactaatttccatctaagcaggcccaccagaaagtagatatggaaaaacaggacaagcatataatatttgtaaagcaaagcattttatttctagaggaagatttgaaatccatggaagttaggagataacacagttgttttagttatttgtcacactttaaagtcattgtagcagttaggaaatagtgagatcttggcaaacaaaatgtggacatctaggagaagccaaagagttggcaacactttttaagcatctctggcagctcctgtctagttggactaaaggaataccatatcctattataaatcacatttccctggaactcagcttaaagggcaaactttagaaggaaaacctccatcatcctcattcaatacttcagctactgtttcttatccgcatctaaacaaaggccattaaatagagtttcagggaaaggcagagctgccaggaatgatgcagagatggcctttttctttagtaaaccagaagcttaaatgggcatgactccataagattttttgttttagtaattagcaaatagagtttcaaattcaaattgacttgaagcaagcagaagttttaaattaattaaattttccaggaaagggaagcctagccctaggaacagagattactcaacttgtaatgcattcctcaggcctaagtatccacacctataaagaatgacttggacttgcaaaggtaatagagctacttaagaagaatctctccaacatccctctgagaagcagcccagaaagatacaaggcaagggaaatctttccagggagaagaactcaaggtgctgaatggcttttaaaggacatttctgagccgggtgtgttggctcatgcctgtaatcctagcactttgagaggtcaaagcgggtggatagcttgagtccagtggtttgagaccagactggtgagcatggggaaatcccacctctacaaaaaatacaaaaattagctgggtgtagtggcacacacctgtagtcctagctacttgggggctgaggctggaggatcgcttgattctaggaggttgagggtgcagtgacctgaggttgtgccactgcacttcagccttggcagtagagtgagaccttgtctcaacaaaacaaaacaaaacaaaacaaacaaaacaaaacaaaacaaaacagcaaagacactttctctatttccaagggagcaagtcaagaacattttatactgcctgctcctaacaagtgattattctcaagcccctttctttcccctaaatgagataattttattaaggtaattctgtctgtggtgcacctttatttgcccctctgaatccttctccacgctccaccttcctctacctgcaatgctatcctgggaggctgacctgcatgaaaaaccttaaaggattcttacctcctctggcttccagttgggttcagccaatggcacagcagtagataagaaggaggtggggcgggcgcggtggctcaagcctgtaatcccagcactttgggaggccaaggcgggcggatcacgaggtcaggagatcgagaccatcctggctaacatggtgaaaccccgtctctactaaaaatacaaaaaaaaaattagccgggcgtggtggcgggcgcctgtagtcccagctactagggaggctgaggcactagaatggagtgaacccgggaggcagagcttgcagtgagccgagatcgcgccactgcactccagcctgggcgacagagcgagactctatctccaaaaaaaaaaaaaaaaaaaaaaaaagaaggaggtgggaggctaggagctaggataagggtacttatcttaagcctccgttcctgtgtccctcagctgaaggtcactgctcatttcaggccaaatggcttcatgggactctccctcctttagtaaccgctggccgaggggcaatagctcagctactacaaaaccccgagctcttgaattataaatcagaattaccctacgtccacacttaatttccttcttgaaatctactctctacatagacaagtgaattttcccctccctgaccaaatcaggcctccaaatataagcttttgtagcttgcttaaattcttgattaatttttactattaaatgattagtttgaattctcccttcctctcacagaatgtaagtttcacgagagcagaaagtgcattagtgttgttctcagctgtttgctcaaggtttaaataaaaacttaaacatagaaacaaaaatttttctttttagttgtgctttctattttttcttgggaccctgatagacagaacagtgaaattcatcatctaactgaagattgcagtattttggaacttggcattaaaagcctgactcaattacactgaaggagattgtacatctcacagaaagcttggacttgagcactgacctccagacactacctgagaaggtctagtagacatgattttccattggagaggtggtggtgtttttgatggcatgtagattgtgactggcaggggcatttttggaatgtaagcatgtctttgagtatgtgctaggtaaaattgaagagtagattgtagtgagcctccactgtggttctgctttatgccaataatttttcttttaattttctattcataaaataatctgcattaggacttttgccaattcagcagaattatgtcattaatacaaaggattataatagaacataaattggctggcccatgcatgaaatccaaaataatatgagtattcacaattttgacaaagcattcaccttaagaagaggcaaacaagcagggaactaatacagatacagttaggtttggtagaacactgatacttgtgatatttatgacataatcatggttctttttgtcataatatggtattttatatagctatttacttaagtgactatatgcatatgaactactaacatttttcacattttctctgcccatatttgggctgctcaataacagatagaaatgttatagttaaaaagaaaattattggccaggtgcggtggctcatgcctgtaatcccagcactttgggaggccgaggcgggcggatcacgaggtcaggagattgagaccatcctggctaacactgtgaagccccgtcttactaaaaatccaaaaaattagccaggcgtggaaggacatgcctgtaatcccagctacttgggaagctgaggcaggagaatcgcttgaacctgggaggcggaggttgcagtgagccaagatcgcaccactgcactccagcctggatgacagagtgagactccgtctcaaattaaaaaaaaaaagaaaaaagaaaattattatctggctgggtgtagtggctcaacctgtaatcccagaactttgggggctgaaggggtggatcacctgaggtcgggagtttgagacaagcctgaccaacatggtgaaaccccgtctctactaaaaatacaaaaaaattactgggcgtggtggcaggtgcctgtaatcccatctattcgggcagctgaggcaggagaatcacttgaacctgggaggcaggggttaccataagctgagattgcgccattgcactccagcctgggtgacaagagcgaaactccatctcaacaacaacaaaaaaaaaaaaaaaaagaaagaagaaaaaaagaaaattgttacctattctccttagataaccctaatcttaatctagtaatactgtatcctttttgagaagatttcagctgtatcctttttgagaagattcagctaaaggttaattcagctaaaggttaacttcagctaaaggttaattggttaacgtgacatattacgcttaaaaatccctaaatgagtcgttttaaaaacctgtctttccctctaatagccagagtttctttgtgctattgtgttactttctgattcatccgagtgatgcttgagaatgccaggaaaacaataaaaacatttcttgccactgagccctacctttgcctggaactcagtgaacatcctccatgaggtggcaaaattgttctggtattagtttgtagtaaaatttcctgaattaggagtggaaaggaagacaatattatgtaaaactttccgtgggttcacaaaaatgaagtgttatcttgtgttcagatcccagacttagagaaaatgattgtgttttctttttcttttcttttttttttttttgagacagagttttgttcttgttgcccaggctggagtgcaatggcgcaatctcggctcaccgcaacttccgcctcccaggtttaagcgattctcctgcctcagccccctgagtagctgggattacaggtgtgagccaccatgcccggttaattttgtatttttagtagagacggggtttctctacgttggtcaggctggtctcgaactcccaacctcgggtgatccgcccgcctcggcctcccaaagtgctgggattacaggcataagccaccatgccctgccaataaaatgattttgaacatatagttctatattatttatagtgaacatttaatggaggggaagttctgccttcaggaagactatgaatattgggactgtgtccttagtagacttggcactaaaaaaaatcactcatttgacatcacaagattgcacaataaatattggagatgttggaaaggtacaggtacacaatggaatactacacattcgaaatgaagctgtagaattgaatttattgacaaagatgtttataatatatcatcattaagtgcacaaaaagggtaaactatatgctgaaggatagtttgggcagcaagcaaaagaacatctaattcaaaatgaattaaataaatatatttatttttataattatcataattacatttattaatctaattgttctagtgcagaggtaaaataggcttcagggtagactgattcagtgacccaacaatattattaaaaaacaatgttctttctgtctctctgctctgtaatccaaaatatctgctttatctcacagctagttcccccaaataattgtaagatagattccaggtgcaattggatattactacttgctttctcattcatatgctgaagaaagagagaatggcttgttattgctttctgcaaagaccaaagaggaaatttttgaagtctgtagccactatctcttcatttatcattggctagaactgctgatttctaaactgatagctggcggaaagaatgtgattatctttagaccagtcagactcacacattgagttaaaggcaatttctaaaatcagagtactgccatttcatggatagtagaatggaatgcatttggggatttggacacagttaaaaaaatctctatctaatctctctctatggatattctagaaaattaatattgtcatatgatagtatctggacaatgacttacatttctttttaattttcttcctttcactcacatgtatataatattcttctgtaaataagcatacattgttttttgtctctttaacattttatatggaaaatttcaaataaatccaaaaataaagatagtaataaaatgaaacctcaagtatccatcacccagattcaacaattatcaacttctggaaaaccttgttttatgcactgtttgtaataagaaaaaaaaaagttgattttagttaaaaaagaagttaagatctgcttaacattttctcttgtccatagaatataccttaaagcaaatcagtaaagtttagctaaggatagcccaatatttttcctgtcaattgcccaagatctctcttaaattataccccaagtatttttttgaaaatttggtttttctcagtttcttatcctacatatgcatctcaaaaatttggaccgcagtaccccaacatcaggagaaaagcacaaaactctaggagcttgtgtatatgaaacaaagtggctcactaaaagcatagttattttgaaatctcatttttagttttaaagtctgtatttttttttttttactctatctaccaatgtttaatagaaataaaatatttcaaattactcaccattgaataaacttgacactgttggaagatggtccatgttggtcttttggcttcttgtcctctgaggcaccctgacaaatacccctgtgaacacaaggtccccaatttaagagtcatagattatagttttcttcccttttaagactccccttttgatcgttgaccatatttccttgacttttaaacttcattctctttgaggactttgctttgaattcagtcctcttgttttttccattttagacctcctcagctcgtatgccctatcttaggattaatactcactttccagtcctggccaggcctggcccagtactctgcaagaggatcttggacctgtaagtcacaaatatcaaggtactcattcatttactaaatctttattgagtatcaaccatgtttctggcacttagctagtccttggggatactgtggttaaaaaggataaaatctcagtgtttaagaagactaaagacatcaggaacacaaaaaatatttaggcaattataaaatgggcaaataagtgctacattggatgaagtactgcatcctataaagcacaaagcagtatcctaagcagatgagggaagtcttccaggaatgagatgcagtataacaataggaaggaaaagtaagtggtggtaattttctatatttgaatgaaaacttactcttgctcaaccacgaaggatgttttcttagaaataaagggattgtcaaaagcagcattcagtatgggagcttacagtgatgtatctagaggggacaagcatgaagagtttgattactcgggagtgcagtttagaaaataactatgtttccttcacagaaaggaagtgttctgccaggcggagtcattgcttccttttctctcttcccttagtcctttgttttcttttttcttttgttttcttttctattttttctattttttttttttttttgagatggagtctcactctgtaactcaggctggagtgcaatggtgcaatctctgctcactgcaacctctgcctcccaggctattctcctgcctcagcctcctaagtagctgagattacaggcacatgccaccacaccaagctaatttttgtattattaatagagacaggggttttaccatgttggccaggctggtctcgaactcctgacctcaggtgattcgcctgcctgggcctcccaaagtgctgagattacaggtgtgagccaccacgcctgggccagccctttgctgtcatatcacatgtggaacatccctacctgcctctcctatgccttcctacctgaagaaataaattaatcattttcccttctaatctacaaactgtgtattatactgaaacacaatgatactttaaaaaatttaagaattaaattgattcaaattttattttatttttagattcaactgattattttgattacttaatcattaaaaaatgatactgttcagtattcagaaagtttgggttcatttttttctttcttgtttctcaataaaagaaatgggtagtggtagtgatgttggcatttgttctgaaagataaatgtgacatgatactcatttcctgcctggcgcggtggctcacgcctataattgcagcactttgggaggctgaggcaggtggatcgcttgagcccaggaattcgagatcagcctgggcaacatagcaagaccgcatccctaaaaaaggagtacaaaaaaaaattagccagtctcataacttggcctgaaaataaataaataaataaataaatagactcatttcccattgagtaatccagaaagagacacaccctgaatggtattgcctaggttttcttctagggtttttatggttttaggtctaacatttaagtctttaatccatcttgaattaatttttgtataaagtataaggaagggatccagtttcagctttctacatttggctagccagttttcccagcaccatttattaaatagggaatcctttccccatttcttgtttttgtcaggtttgtcaaagatcagatggttgtagatgtgtggtattatttctgagggctctgctctgttccactggttataggaattggcaaggacttcatgactaaaacaccaaaagcaatggcaacaaaagccaaaattgacaaatgggatctaattaaactgaagggcttctgcacagcaaaagaaactaccatcagagtgaacaggcaacctacagaatgggaggaaatttttgcaatctacccatctgacaaagggctaatatccagaatctacaaagaacttaaacaaatttacaagaaaaaaatcaaacaactccatcaaaaaatgggcaaaggatatgaacagacaattctcaaaagaacacatttatgcagccaacagacacatgaaaaagtgctcatcatcactggccatcagagaaatgcaaatcaaaaccacaatgcgataccatctcacaccagttagaatggcaatcattaaaaagtcaggaaacaacaggtgctggagaggatgtggagaaataggaatgcttttacactattggtgggagtgtaaactagttcagtcattgtggaagacagtgtggtgattcctcagggatctagaactagaaataccatttgacccagccatcccattactgggcatatacgtaaaggagtataaatcatgctgctataaggacacatgcacatgtatgtttattgtggcactattcacaatagcaaagacttggaaccaacccaaatgtccatcagtgatagactggattaagaaaatgtggcacatatacaccatggaatactatgcagccataaaaaaggatgagtttatgtcctttgtagggacatggatgaagctggaaaccatcattctgagcaaactatcacaaggacagaaaaccaaacaccgcatgttctcactcataggtgggaattgagtaatgagaacacatggacccagggtggggaacatcacacaccagggcctgtcatggggtagagggagggaggagggatagcattaggagatctacctaatgtaaatgacgagttaatgggtgcagcacaccaacatggcacgtgtacacatatgtaacaaacctgcatgttgtgtgcatgtaccctagtacttaaagtataataaaaaaataaaaataaataaaaaaaagaaagagacacacccaaccattattgaagtcctctaaggtggggatagaggacacacagttcatcagggctgaggaatagagaatgggaaaacagatgaagaaaggcctgtgctgaccttttccatgccctcccatggatgtgtttttcctgcacgtcaagttatttaagcaaaggattgtttttgtctggatttttttcttttccaacttcagccatttcttttgttctttttaggcatgaaacattaaataaagttattcttaatatgggatattctcccctaagtctttttagatgataaggaaacagcatgtccattccaatagcctgttcaagagttctacttttaataatttgtgtctcatacttccagatagtccacacatagggcaggtcttattatttcttgtgtatttcattataaccttattaggcccaaacaaaataagagtcacgaataggcaggaaaacatatgactgtagtaagctaggtgttgaacaggaaactgtggcttccagagattaaaatagttttgtttgtgatcttagaggaaacccaaaaggtgttcacttaggtctggttttaaacaggcagaacaacttattttaaagtaatatttctggtaattctgcagctactttgtagtgcctctgctgttctaggcattgtgctagatggtatgaggaattaaagatgaataagaacaaagtttccttcttaggagggaatacaatctaagttagcttttctctttatttatttatttatttttctgagatggagtctcactctttcgcccaggccggactgcagtggcactatctcagctcactgcaagctccgcctcctgggttcatgccattctcctgcctcagcctccccagtagctgggactacaggtgcccgccactgcacccggctaatttttttgtatttttagtagagacggggtttcaccgtgttagccaggatggtctcgatctgctgacgtcgtgatccacccacctcggcctcccaaagcgctgggattacaggtgtgagccaccgcgcccagcctgcttttctttattgtaaccaaaatcatttgatgacttccaaacagggcaacatatgtgtcaaatatggtcatatttaaataactatgccaaggttctgcagttcaattaacttcatttaatttggacacttctagtattagaaaaatatctttttttgctatcatccattaaatcatcaatatttttaaagattcacttccatctctctttttaagaatgaggtgttacataaaactataggtaaatgaatttgaaaaagaaagcaagtaaggctgagtgcagtggcttaatgctgtaatcttagctctttgggaggccgaggcaggtggatcacttgaggtcaggagttcgagaccagcctggccaacatggtgaaaatccaactctactaaaaatacaaaaaattgggtgtgttggcatgcaccagtaatcccaattacttgggaggctgaggcaggagaattgcttgaactcaggaggtggaggttacagtaagctgagatcgtgccactgtactgcgccactgcactccagcctgggtgacagagcaagactctgcacccccacccccccaaaaaaagcaaacaagcaagtgcaagtaagactttgtatctctgattagatgttgaacagtgaatgtctcttcccagacaatttagataatttacatacattctttctctggttagccttacagattaaaaaatggtggctttttaagttttaagttgagtgacttatcaaaaatactttaagacttgaagaccaccagtctagaagttagagatgaaatattagaatatggcagtaaacagtccagcctatgaactagaactagattgactgggttcaaatctcagcttagccacctactagtatgagacttgggttaagttaaaaaagcccttgtatctcagttctcttatttttaaaatgctgataacaataatgtttgtaagatgttgtgggcattaaatcaataaatatatgtgaagtgcttgaaaaaaggtatggcataggcaaacactccatagagtgtcacctattatcatttttatgtgagtgtgggacctgctatccaatgacatcagtagtctcccactgtgacataaaaggattgcatacaaagaaatgcttaataaataattcattcgttcaaacaagtatttttgagagcctgaattctagattctggggatagagccaaggaggacaagctgaagttctcagttttaagggactttcatctgaatgaagtaaactgacaataaacaagaggaacaaatatacataaacatattaagcattactacctactttgaagaaaaagaaagcaggctaaagggatagagactaataaggaataataatgggcaagctgttatagatggggagatttacactcttttgaggagatgatatttgagcagagatatgaatgaaatgagagtgaatgctgggaaaatcaacaggaaatgaattctagaaagtgggaacagcagaataaaggccaggaggcagaactgaattcaggggttcaagagtaaacagaaggcccatcgtggcgtgaagtaagatctagtattcgaagatgaggtagaagtagtcaaataattttggatgaataatagatacatttaatgactcaatcaaaatgatgagacatcatgctgaaaggaagcttaagatacatttgtaaataagattataagatgttgagtgggactttttttgttgcccataattgaaaataagaagagctaagtaaccccctttctatgagaagctcttaatagatgccaaatattgaggccagacactgtccccacctactaaagggtatgttacgaggcgaaaaaaattctctcctaccagcaactagcacctagctctggatacgcataaagagaaaactggagagagaacagtgcaagtcagcagacagtgctcacagggaaaggttactcctcttctcaaggggaacagaaggattattatttttttcttgctgaagccaattaatgggagtccatcagagaatgtttagagattgtgtgcgagtttgtgggaaggaagactggcaattcatttctcagctggctggatggtaatttactaaacacaccagtccctctggagctactatggcggagcgggggcgaatgtctccgcggagttgtgtatttgctacctgaagtttaggactcacccctgaatccaaaacagctgctagtcttaacatttctgaaggagaggaaattgctggagtagcttatggtaacagagttagaaggaactgtggttcagagtttgttcttgagaggggttaaattccctcctttatccccatcctggtcttttgtggcccttggagcatttagaagatggtctcagaggttactatggctcaatgcaaaacagcatggtggtaaggaagggagcagaatagctggtagtgaggagacactccagctggggaagcagttaggggcatggtctgctgtcagggtccaggcttttctctgagggattcctcagtgagtgagggggcaaagcaaagacgaagagtgtctatagaaaaccaagcacaccaccagcacagatttctcaacaccaccatctgttagcaatagacaaaactggattgaaccagagaaaaacctaggacactttctcacgcagacatgtaactgattatgtaagatctctaccacctttgtcttctctctctgaccccaaaactagaggagttcagcagcggggagtgaggatggttgtctcagagtcagatctccttccaacttctctactccaagcagtcagcctcacagtttgtgttgagggcaaagaaaggtaatcatatttatgttagtttcacaatccaagttttaaactggacaaaaataaacttcaaataactgaaactggtagaaagttagaagatttgcactttgggaggccgaggagggctgatcacgaggtcaggagatcaagaccatactggctaacacggtgaaaccccgtctctactaaaaatacaaaaaattagccgggcgtggtggcgggcgcctgtagttccagctactcgggaggctgaggcaggagaatggcgtgaacccaggaggcggagcttgcagtgagcagagatcaagccattgcactccagcctgggcgacagagcgagactccatctcaaaaaaaaaaaaaaaggacagttagaagatttgctaggatattcattaaaggacacgagaataagacttgacaatcatgattggaagccttgattagaataaaaaatataactcttttgtatctatgctcttgttgagacacattacatgagtaaccaaacaatgaaacataacactataaaccacagcacatctatggagaaatcaaaatgcactaatcgaaaattataatttcgtgggacattttatttaaatgtaaaatttcatctggcttctcagttttgataaagtagagagtctgtcaattgcttctttcttataataaagtgagtcaatcttccttccatcagcaacatataatacaaattcttcaggcccttgtcaggaatataaactcatactttctcctattccgtttctaaaaaggtcttctaaggaagtaatatttaagaaagttcatctaagaaacattgtaccctttgtctaagtactttgaattctgcctttgaatcaagctagaccactggaagtatatgcacctgaccacaaaaatatatctcctttaaaaatctgtcaccaactttaacttcaaaattttattctcaggcttctttgaattatcataagaaagtttataaaattctcttctatttgttggtaaaaatattgctgatattattcaacgcgttgctcagtgtcatctccatatgagaaatttctccatcaacttagtggcaggaaaaattctctcttgatttgtttctttcttttaaataatgagaattgtgaaactccctaagtttcccttgttattcttgctatcggcaagttcaaagccaaatttgcagctctgtcagagcaagtctcttatacaatatgtacaatgtattccacttcggttttttcttgaatttgaaccttattttatcagtatattttatattttaggggcgttgtctatttgtaaagaaatggagtataggtaaataaatttggttcatgtgctaggaaaagttggttcagatgactgaaagttgatctcctaacatgaaattgattaatctttgaggtgtttttcaaagactacttgcaaaaaaaaagaaaaaaaaaaagagacttaaaatggcccccaaaatgttatcttcattcattagtttaatatcattaaccaggctaaactgtatattccaataaattgaacaataataggattattttaacattattactgtcagttaattctaaaaaccttatctttggtttttattatatgtaccattatatattgaaaagcttagcagatcctcacatcaatgtccagaaaaattatctccagcattatgaagacacttatatcagttgtagaacatcttatagaagaatagggaagagaggtaatattttgggtaagaatgtagcacaagcaaaaggagagtcagtgacagagtagtgacagcttgtctctaaatgctaattaattatattgatcctctttgttttctcagcttaaacaaaataaagtgcatgggtaccttcaaaacaacacatgatagaagggaatggattcacaaatgacaatagctgtgtttacctggacacctagttaattcactagtttaacaatattggccagtctgtaatgtacatcccaataaactgaccaataaaaggattgccttagcattatggaaatatagctaaagtataagtttaagggcttccataaattaatcagattattattatacataggcatttatgtattatcaggtataaaagacatttgttcaagctaggagatattcaaataatgataaaaatcatctatgactagccacctgggaactatacttttctagtttaaagccataagatgcctcattgctttgacattgctaagtataaaaaggactgtagaataatttgttggtgataaaaatgtctgtggtcacattgctattttacttattatgcaatgtaagatatctactgtggatttctaacagactcaagtccacaaatatatttctcctgactgttcctgacattgcacagaatggcacagggaacacagaccaacacacaaaaagaagagtaactctttgaaaacattttcttcacactgtagtttaggacaaaagtattgcagaataaaatttatggttttagaaaaaacagcaacaaaaatttgaatgaaagacaaacttttgctttttcgaacttttggaagacaaaattatgactctaatgtttcattccttcttctttccttgccattcaaatttctactaaagtgtaagatatatcataaaatttgataatatacactgcaatgcccattgagcagactgaacaaaggccattaatatagcaaggaagacatatttttaatatctttagtctgacattcacttgtcctttatttacatatgcgtaatctcttaattttctacaaattgtagcttatactcacagagttttaaaaaaattcatgatagccctctcattttctgtatctacaattctaggttatatattaccctaagtatacaggtccataggcctatataaagaatttatttgaatttgaaatcttgattttgtgaaagaaacaaatgtcttgagattttgttaaaataagtctggcaagtcttggcccaaagttacactgagagggaatctgttttcctttgaaaacaaaagtattatcaatattttcataaaatgtgagtataaaatagaacatagtattattaaaccatattaacatttcattggcagagatttcactttgttaaaggctgtataagaacagcttaatctcataacccagaagtttttactgttattattgcctctttatttttggctaaagtgtaatttttaaatgagtatacagaaacctaatactatatattgaatgactttaagtaaataaatatccatgctattcatcaggataagtgacctagtgaccagaataaaaaggatatatgttggtagcccctagcacagtatgcctcagcacagaggtttcttgggttactgctagtgaatgattccaattcttggccgtctgatcccacacattacataaattccaactcctgcatctgtttaggtgagctgttggctaaatggatatgtaatgaaattaaacaatatttttaaggtgctttttaggatgggttataccccctctttttctcctcctttccttgcaacctgccctctactcattctttttatgcatatttttgagagcctgaatatgctaggaagagggtttcagtctgttaagaattcacaaccttgtggagttgagatacaattaataaaatttctagtataatgaggtaagtattatgataccatgaaagcacagaggagaaacacctactctgttttgtaaggattagggaaagcaatttagagattatacctaacacaaacacacagatatttgcatagtatgtgagcacacgtttaaaaaaatgtaattttcaccctagaaataagacagtagtgattcagcgtgagttgatatgcctgtctccactataatgaaagaaatataacgtcttaagtatgggttgacatttgcaaactaactgatttttctagaagaatgatgccacataatttaaaaatattaatgcttttctaatctctagtgtattttcaatggctaacatagttaaaaccaaagtgaaatttttattatgtacataatcgaatgcaaattgtgtcaggctagtttaaaaaatatgaatgtcagtcctggcttggcaatttaataactatttggtttttgaccaagtcatttaacttaattaaacctcagtttcttctctgtaaacaagagaaggtcaagcaagatagttttaaaatttctttccaaatttatacgtctgacttttctaaaaaatctggtttacactaatacttaaaagaaattatcttaaaacaataaattataaatttattttttgctcttgctccctgtaaaatttgtccttgtcctgctagtcacatatagtccccactacaccagccaagacttgtcagactggttctgttgagatcatcagtgacttatttcctcacttcaattcagcccacaaagtcattgatagagctggattcacacacttggatgtagacctcgaccttcacaggactcttcattgctggttggcaatgatgtatcggtgagttagttccctttttctttctagaagtcttaaggtaacttttagtttaaaacagtatgagccacaccaaggaatgtgtagatctacagtttattatttttttaaatatagaaacatatttttgagattttacataaaattatgtcaagaaaaagatttctattctttctgtattagtgtttcctgtcctcttttgttgtatcccatgtgtttttctgtttacttttagaaggtttctacacaatgtaaaggtacatggtgtttgacagctgtcttttagttagtttggccatatgtttcaagaaagatataacatatttttagcttgggctttgtttgtcttattgagaaacacttttattttagaaggtgtacatgaaaaaaagtctgaaataatgcagaaaaaaatgtttatttctgtaagtagttaaaaatttaaaaactctagatgttttgaaagaatcagaaacaactgaagaaaataatatgactaaattattatagcctgatttaaaaaataaatccactgatatgcctggccatagtcaacttctccaaagataagtcatgatcattttgaggttttctttcaaagttagaaactaatcagtaacaaggttttggggtactagttttgtctttgaaaataattttatctcctgattaaaatttattttctctgattctcatattggcatatcattttttattagtttttactttgagaacagtttgaaaatgttaaactttgaatgaaatctgtggtcttcatttaacatggaaaaacaggttctgtcatcagttgaaagttctacatacttgttattagaagtttaatactcttctgtacatatccatgaagcaactaaaagctacggatactaaacattttgttgggcttatcaaggctccctgccttttgcaagtatttctttacaaccaatgatggttttgtatcctattctctttttctcattgactttactatagaaaacagtgcttcaagaaagcttccaataaacttaacatactaaatagattacaagccttatctatggtatatgtcagagatttggaatttggttataaatgtgtagaggcggtataatgtgggaatactggagtgaatttttctgagtgtagtctctaatttgaagcaaaagatgtgactatttttaaaaatcctgctgcagaatagatgcaaataatctctcatggaaaaaaccaaaaaccaaaaccaaccatctaacaaacaaaaacgtcttcctgatctgaagattgtatgaaagatgaagcacatctatgtttgagtgggtctagatgagataaaatgttaagagcatgtactagagcaaaaaaggattaagtttattattcacatttgctgtcgtaaatgtgccaacaggagtgttatcgaggaagagggataattgaaatcctaggatataagtagacaatttcttcttaaggtcattggttttaactcagaaagaatacaagaaacaggtggggaattttattaaatagcatgctccttccttttcagtcagatttcggatagccttctccctgactctacctgaataagaatcagttttttttgtttttttttagaatttaagggtaggaaaaaatttaaactgggtaagcattattcttcttgtactgccattttctccaaactcttattttggactattctttgagcatgaagagatcaacacatgaattttataaacacacaacagaaagttaaagaaaactctatcaggcataagtttatagagaacagatttgggaagagaagaatgtgtccattaaatatatttattggtcataggggtgtatactaactgtatttatcagcaaccactgagaagaagtgaaaataagcagactgaatttataggcatcgacatccacacatattgagatggctgaaggtgaaatgagtaatattcaaatgagacaaaatggacaactttaatttttacctaatagggtaagcactgtctctaaaagtgtggtccgtagacccctgcattacagtgcttattaaaaataggaatctccagctctcatcccagaaattctaatgaatctctggttgagacatggaaatcatatttaaaacatttacacaatgtaattcttatttaccctaaagtttgacaagcactaatggtgtaaagacatagaaaaagaaaaagaaatgtgtaagcctgaaagaaattaaaccataaatgaaataggccagttgttaaaagtagttctgttttatttaaattggtgtaattacatcttaatgggaggtgctctttcccagtcacctttcccttcaagggagaagagtactcatttatgcaacatggtgatgattaagaaagagaggataatttcagaaaggaggggaaactgaggggggagaacatagacattttttgcttagtttgtgtctgataaggaagatgactttatatggatcataaaaatctatttgtttacaggaaaaaccttggtataaaattaatgtagcagtgttaccctgtgacattagtcagtatggatactgaagagacactccttttaggcttaggcccagagttgctatatggttgtgttataagtatttagcatgtgctcacacttctccttcaactagaatcagccctgatccatataacaacttttagtgagttctcattgcatactaagtcctgtgtggaagaaaactctctgttgagcacctactatatattgtgtattttataaaatgcaatttcattaaattttggtaatgttttgataagtggttattgctttcattccttttaaaagatgaagcacctgtggctcagattgtctaggcggttagtaagtgtcgaatctagaatctaattctgatctttctgattttaaaatatacttttttccctgtaacatattgtctaccatgtgtaggaagctataagtagaatctttgagaagtttacagagaaaatagatggcaacagagaaatagaaaataaacgcacacatatccacacatggagaaaatgttggtgcatagatttaaaaaaccagaagatgtaaagactaatatgaaatcatgcacatttatgctgaggaaagaagtgtggaggtgtaattttactttcatttataagttttaaaaacattttaaaaaatgcattgcctgcccttatacaaccgactttgtatttaaactaaataaacagtgatctatcttttctgcactgtttcaaaggtgatcagagtatagcactttaactacatcatctctgttttctaaaaaggattacatttgctatattgtgaaaatcatgtttatcttagagcaatatttcatggaactaattcactggtctgcagtagctgtctgctaaatgaatctttgttgttctgtcattgttgtctgctttcctccaaaaatatgtcattgcttcaacttaaagagaaaataaatagaaacaatccagagaaacatgaaaaatagcagtgtcgtgtgtttccgtattagcactgagatttataagcatgcctgatggttttagtgcttgtgaaagaggtagattgaacagtcgtgaagcaggtcttctggaagggtaggaggtaaaatgggttctctggcttgttttatggctctatcagggttagagtttagagaaactgcacagagaagttcttcaagtgcgctcctttggatctgctctcattgaagataatagctaagaactgtgaagaatactttcacattttcaggttttaataggtttaaaatgactggactagagagaaggaaggttttaagaggttgagaaagaaaaatgggctgcagaaacactgagtcatgccagaacctgtaagcccaaccttcttctcccatgtacacacatggcctgtgtggtagggcaatttttagaattgcaattctaagatgatagaactaatcttagggggatccaaagtactatacaggcatatttaaattctattttgcaaccttttatctgaaaatgtcagatgatatctctgttttgaaactgcaaaagcagacacagagggatttagcactttgtttaaagttgaactgtgagtcagtgcaggacaaaataataattgctatctttagtttcacatgtactatctgccaactactgtcttaaaacatcatatgcatttaaactttatatcaacctatggttatattatcatactcattttacagatgagaaaaatgaggctcagacaggtaatttttttttgcccaggggtaataataaaaggcagaactgatggttaaccagggtctatctgacttcaaagcctatgctcttaatcacagtgctataccaccctcacaatgtctcctttgtctgcctaagtggttcttttactactttgatttaactgacttactgtcttaaaaggtgaaaaatttacattttcaagaaacattgttatggatgatctttaaagtagacctctaaggccagtggataggaagcattgctgtatgcattctctaaaggaagggaacaaaatgctcaaagatgagataatttgcatgtggccacaggaatgggtgagtcagtcaagacagagatgtagtctgtcctcccacttcacctgtatactgatgtcaatacagtcaaacagaagagttaaattaacaccggtggctacatgacccaagacatattattgttatttttattactattaccatttaagcttgtatgaaaatatgtggcccatttaaaattagttactttacattaaattttgtcaggtcacagttagtaaaatttagagagggtacatatcgtaacaataaaaatattatttgacgtaaatatgctacatatgtaatttcaacatatgttttctcatttggtactttacaacactgagaatcagataattttaatattaccatgactttacagctagggaaaccaaaaattaggaagactgagacttccaaatctctgctaagtgactggtagagctggaatctgagcacacctgttctcacatcagccctgtgctttctagtcctggcttctgccaggtcatgattctgggatcagaagtgcttctttggtgaagcacagataacttaccttggctttcaaaaaattactttatcttagtgtttcaactttcctaattcagaaaataccaaagataataaatgaacactttaaaaatatttcaaaccaatcttttaattatatagtacattcaagtcattattaggcatttggggatacattatttgattcaacaataaagctatatttggccttttaaaaacagggtaatgaattcttgtactaaactgtaggacaactggcagctgcctgactcaaatctctgaattggatgggtccgaagatgaacgctttttaaagttttctttactagttgaatccctttttgcactggaagcttaatgcagacccttgatgtttggagcagaattgctgtgggtggagtgggatagaggctagaagcttcctctaccttcctgtcttttattcccttaggcatacgtgaggcatctgagtggatttttcaacccaccttaaagctaatttttcattatgaaagaggaaataatgacaatggccaacttttgtggtgtatttactgtgtgcctggcatggtgccatctcccttgtgttactttatttaatcttcagaagaatcttctgagttaggtcttatcattatctccatttgtgggtggggaaatgtagatttagagaaggtgagtaactttcctagagccacctaactagtaacaggcagttaggactaatcccaagctgtttgatgcctaagcccaagtctttatccactaaacaagaaaatggaagtcatttgcttaaagtcatagagcttgttacaaagaggctcttgactagaaccttggtcttctgatatattaatattataattattaattgtatctcaaaattatgctgctagagaaaattaagttaaaatagtttaccatctttcacatatacagaatttgcaagagaattagtaaatacacgtcttcatgtcctcttttcccaaagatcattatgtgaaagtggcaatttcccttgattgcaacaatctgttttgcatattataatagtatcggatttagctacgagtgacaggaaacccagagtaacaggggattacataaaatggaattttattccgtttaatgtgaaacaattctggagataggcaggtaagagctaatagggaggttcacaaaataattaggaatctagtctcctactattgtgctgtcctaccagcttgattacgtgtcttccaaatcctggtctactgtggcaatccatgcttcaactagcacatatgtattctaactatgaaatgcacattaggattccagccaacaaaatagagactccattggaaagaaagtattcatatgctgactcttatggacaaggggcactatttgatttttctggtggctgtgtgcctaaccaaagatcaaggtttctgttattagaaaaaaaagaataaatatttgggataggcgtctaggagtttctagtatagctgtattaagtttgaatggtaagaggtatagcccattgtgatgaacataggctggtggatatatagttttgaagtgtaggcaagtgagctgagctgcagttatagatttggtagtcatcagtatatagatatgaattaaacgcatggacattggtaactaaaagtatttgttcttttgggtaaaataatgcatttcttataatttttatggtattaatttgcacagaaatcctactttattctaatatgaacctgagcttatttcactatgttattattaaatgccaatatattagaacgtaattgtcaaggtgagtatataataaaaaatttcataaattttatgtaccatccaaaaattaaaactgaattcttacatatatttcaggtcgataactggggcagaaaattctttaatcaggaaaactcacttttcattttggaagaattatttaaacatcgagagggtctatacatttttcaatttctcctcattgctgaattaattcagatagaattttgttacatgtagaaatttctagactgtctaaagaattcttggtgtatggtttagagtgctttctaaggaaacagcaagccagaggacacaacaaggtgtcagcatgtggcccaactgtcacattcaggcacattttaatcagggtctagagattttaaaaagttggtgtatagtagttatacatattttgggggtatctgtgatattttgatgcttgtatgcaatgtgtaatgatcaaatcaaggtaactgggatgtctatgaccatcttgtgttggaaatattacagttctcttctagctattttgaaatgcaaaacaagatattgttaactaaaatttccctactgtactgaatggtagaacttattccttctatctatacatttgtaccccttaaccaacttctcaatacaagtagtaaagtatgattttcaaagtctggctttctcaggtatggtatttagattgtttcaaataacttgtagtctcttagtttgactgcaaattatttcaaattatctgacattgtagtcaacagaaaaatgaggcatttgaaaaattgcctgaagtctgattgtttaacaaatgctgaattttaattaggatatgtaactttttgtgttatgtgaggcatggaacattagcttggatgaaaattgaagaccatttagatcaatttaaatttccgctgattttttaacatgtgaagaaaaggagagctctcaatatcatacaagttggggctcaggggatgctggaactcgtttgatgtggagtatgctctcagatttctcatctgtttgaactaacactaagacataggttactggttttacagtttagatctacttccattctatcatgcaaactttcttggagtcatctagacaatgtcaagaagaagatttggtaggaagacagctaaaattttaaaaagtttctgaaagtctcaagctatatattagcagccacaagagtgtctctagctcaggtttctcaatcatttttcttctgatacacttgcagtgatatcagcacactgcttgttaattcttatttttcttccacattttgaagtgtgtaaaattccctatgattggctgcaatggcatcgctcgttaactttgctgtgggatattgttgtgtataaagttgctcaggtaatgccagtttattatcttgaactaaaaagagtttgaggaaaagaaagcaaatatattagtagaattcaaacttcagtagcttagtttaagtctataaacccataactaattacttaataatatctttaatttttttgcaacccacctatctgtatgtagttgcaaatttctagagatcaggccaagtgtcaacttaaatatcagtttgtagtcacctgtgctgtaccatatttagttgggaacttaataaaaccttgatgataatcacagtggaggtcagagacattccttactgttgagttgccactaatatttatgtagtacacctatctaacaaagtctattgatatcatatgcaatcttcacaacctccttttaaaggtaagggaaagatactgtcacgtaagttttatggttggctaaacagaaatagttaaactctgggttttgtaacttctctatgagaactagccgtaattattatggtagggaatgcaaacattgtgattcagcccaagcgcctggctgatgctatcagatacttatagatgtgttttatcttccagtggataggacagaaatatgttatttgtaattttatgtggagtaatttgcttgtatttcttctttttttaaaaaaacagcaatgaaaatatataatccatgcacgtatatatgatattctgttttatttctactgtggatatttttatagtcctgttctagaaagtgtgagaaggattaattatgtcaccaatgcttgctggtttgggcttttcacaaagtaaaacacatctcaaatacttttgttgataggataagcaggcacaatcctatgagctaagctacggtcaaatacatatcatatgccaaaacaaatatatagaccaatggaacagaacagaggcctcagaaataatgccacacatctgcaaccatctgatctttgacaaacctgacaaaaacaagcaatgaggaaaggattccctatttaatcaatggtgttgagaaaattggctagtcatatgcagaaaactgaaagtggacctcttccttacaccttaaacaaaaattaactcaagatggattaaacttaaatgtaagacctaaaaccataaaaactctagaagaaaacctaggcaataccattcaggacataggcatgggcaaagacttcatgactaaaacaccaaaagcaatggcaacagaagccaaaattgacaaatgggatctaattaaactaaagagcctctgcacaacaaaagaaactatcatcagagtgaacaggcaacctagagaatgggagaaaatttttgcaatctatttatctgacaaagggctaatatgcagaatctacaaagaacttaaatttacaagaagaaaacaaccccataaaaaagtaggcaaaggatatgaacagacacttctcaaaagaagacatttatgcagccaacaaacatatgaaaaaaagctcatcatcactgttcatcagagaaatgcaaatcaaaaccacaatgagtaccatctcatgccagttagaatggcgatcattaaaaagtcaggaaacaacagatgttggagaggatgtggagaaatagggacatttttacactgttggtgggagtgtaaattagttcaaccattgtggaagacagtgtggtgattcctcaaggatctagaaccagaaatactatttgacccagacatcccattactgggtatataccaaaaggattataaatcatgctactataaagacacatgcacacgtatgtttattgcggcactgttcacaatagcaaagacttggaaccaacccaaatgcccatcaatgatgtctgttatacgtatctcatttcttcttcaatgatagactggataaagaaaacatggcacatatacaccatggaatactatgcagccataaaagaggatgagttcatgttctttgcagggacacggatgaagccggaaacatcattctcagcaaactaacacaggaacagaaaaccaaatactgcatgttttcactcataagtgggagttaaacaatgagaatacatggacacagggagcagaacatcatacactggggcctatcagtgggtggggggctaggggagggatagtattaggagaaatacctaatgtagatgatgggttgatgggtgcagcaaaccaccatggcacgtgtatacctatgtaacacacctgcacattctgcccatgtaccccaaaacttaaagtataatttttctttttttaaaagaccaactattgattggtggtattgctgtgaagaggcttcttctggtaaatttttctttgaaacactgagccttgacttgtcattttccagtgcttgccattagctttatttgcactagtacattttccccttgtctttttgctgttgctgctgcttttcttttttagcactattctaaaaattacacattaataagcaataataataatgcagcctaagcatattgcttgttttctggcaatttggggctaaaaaaacaaagcatactttaactgttatattcacttgacttgtcactaattatacatgtctccagattgaaaagaaaatcatataaagaaagaaatttgatattactaaagctgttagaattcaatcagtctatctgaaggtgattttacacgaataggtgcacataagttttgatagatgaaaatattgactggacaagtgtttatgtatgttcaggaggaggttaattatacaaacgtctgttgatatgtaaaataaatttattccttcactttactactttctttgagcatacttttttcacatctaatttggaggaattcagtattgaatcacttactgagaaaataaaaaagtaactaagaaataggatcaattatatctcaaaaaagctaaaaaatagggtgaatcagtttgaaaaacaatgctatacagactgggaaaagaacaaataatgtttcaagtgacaaacatcttagtaatgtggtcattaccactattactaataattaaaataatgatgatgataattatcatcctcgttatttgtacaatgatttttccacttgggagctcaaagtaccaaaccgccttctcatttttatctctacctagctcattaggttaggaggggtctggacttattatccttgtttttcatatggagaaattaagacagataattgaatctctgcgtacaagactatataataaatgagttggtggcagggctcagaaatataatctcttaattgtttattcaaagtatttttgactggattctctttttcctttgtcccatattatcccttttgtctacttctagccactcaggagagcatgtcactaaaatagttgtgagtaatgtggaaaggtgggggtcagaagaagaatcacagtggtaccttggacactgcagtgatgtaaattccatgaaaatacatatataatcttccttagtttttttttcatattttaagaatgtcctatgtctctcgctctcttttttttaattcaaacgccataatgttgttcttaaaaaatccaccataaaacaaacaaatccataaattaaaattaaaatttctcacttatttgttattcggcttcttactaataaacattggttgtgtcttctatatattttgttatgcacacacatatatagtttcattatttatgaaaaccgaaacatgaaatgcatattattctataactttttaaaattgaaacttatcattaacctttttaatgttaatacatgaaacctacttcatcaatagaatggctgcattgcttacatttttgtcttgattaaaacttactgtagaacaaatagaacgtgtctaatatttcacaattctatataacaatcatatacttttgataatttcatgttttctacaagcacacattcattttcttcatctgacatgttttgatattagttgagaaacccttctctccctgtattccccccaaagttttgcttacgtgtgttatacccatctcctttcttctgtaacagattaatagcaagcattcagggatgaaggaagaagagtcagttttgggggtttcttaggctcagttgcacataaaacataatctcattgtggagaagactttttatattgcagtaattgacattctaggaacaggtgtttggaattctactcaagggaaaactggagatgggaaaggttgaggagagtaagataaaagcttccctggttacggccccgtggaaaaatcacaggaacaaggcaggagaacaagcagagcccctggagccttccactacatctcagtccctttcccagggacaggattatacagcgatgataacaccattgacttctatgccaatgctctttattttgtgtccagccagagccaggatctaatgatggtgtgacaggggccaacatgataatattatcacttcctgatcctatatcatcaggaaacagagcgttcttgttttctgtaaacaaaaggcatttattgtgaaatgctttgctgtttacacgttcatgatctaattttaggtcccaaagtgctttagacggaatggttatcccgccccttactgatatatggggaaattgagctcagagtttaaatgatttttccgtcgctgatctgttaatgaaagggctgcacttagaattctccttattctgattcaacacccagtactcctccaggagaataccatgttttcctcaagtcctcatgtagcagacagttagcactctagaaaaaagaaaaaagcatagcacacactggcgtaaatacctcaagaaatctaaaataagagtatcatattcaaactccttagtcatctctgacttattatttcacatttctggctttagagtttgcttaccaaatattataacccaatgggacagcaactttaccaatcaaacaaaaatcatgtggatcaatgtttttcagtaacatgtatttttgaaggcagaacaaatagaagttgagggaatctcatgcaaaaagaatttcctgtagctttttttttttttttaagacggagtctcgctctatcgcccaggctggagtgcagtggcccgatcttagctcactccaagctccgcctcccaggttcacgccattctcctgcctcagcctccagagtagctgggactacaggcgcctgccaccatgcccggctaatttttttgtatttttagtagagacggggtttcaccatgttagccaggatggtcttgatctcccgacctcatgatccgcccgcctcggcctcccaaagtgctgggattataggcgtgagccaccgtgcccggccttctgtagcatcattaaagcttaaaggtaaatattagctcaaaacctcaggttctttaggaaggggcctctggttgtttcttctatgtatcctcaaagtttggtttggaaatagatcagaaaattagaagaatagaattagcaactccatgtgaaacctggtatgcttcaagctgtaacacacttcaaaggctatttaagattctagagtgctagagaaaaggcttaaaatatttttgtagcccctgcagtgtctaactctatatcaagtacatggctggctcaacaagtgatagctaacatttaatattgcacttttctacatgtcaggcattgttacaggcactttatatgtagtacttcatttaatcctcacaataatcatatgaaataggtactatcattatcatcttccttttatggatgaggaaacccaagcacaaaagtcaaactacttgcctagcaacaggagtcagagtcaggactggcctcagcagcctggaaccagggtgtgctctaaacccagacagtacacgaccctccaactgaatgtcctttattcccccaaaatatctgttttgtctaatgagtggatgtgttgcatgctctgaaataatctatctatttattttcttccttaggccagatgtggtgagggctaggaaaagagtttgttgggaaccctgggttatcggcctcgtcatcttcatatccctgattgtcctggcagtgtgcattggactcactgttcattatgtgagatatagtaagtataagctgccttggcatcatgtgatttaccccaaatatttcctcataccttgctgttttgatttgcctcaggcttattcatttatcactacgattcatttgcatagcctgtacaaagggatctttacctgctttctctcttatttagtcctcataagtcaaggaggattcttttttctatctttgatgtagtgatgctttctgctgggaacagcatgcttatttgcatcttccttaataagcaataagtgagtattaatcaaaggaaaactacaggatagctagaaccaatgtcttgagttgtttgaggtcacagggcaagcatcttgatttaaaataattctgaccgggtgcagtggctcacgcctgtaatctcagcactttgggaggctgaggcgggtggatcacttgaggtcaggagtttgagaccaggctggccaacatggtgaaaccccgtgtctactaaaaaaaaaaaaaaaaaaaatagccaggtgtgatggtgtacacctgtagtcccagttcctggggaggctgaggcaggagaatcacttgaacccaggaggcggaggtttcagtgagccgagatcacaccgctgcactccagtctgggcaagagagagagactcggtctcaaaaagaaaaaaaaaaaatccaactcgttgaagtcctgacatcccaataaatcaatgacacaatctggagtcataaagaagtaggctctattctgtaccagtaagttacaaaaatagtcatagtgatgtattgttgagtaagtgcctatttctgttattaaaatctcatcttaggatatattgtaagtgattaaagaggatagggtatgccaagaaagctaattataaagatgttcaccctgcggttatcaggtacctcattgctagatgaactgttagttgctatgttattagaaaggtctccagggtacttcagaactgttattctgggatgtaacagcccttctgaagtttcctcctactctgcctagggttttaattacttgactcaaccatgacctgttagtttaatatcttcctctgttactagattatacttggatgttcaaggcaccgtaaccatagaagctaataacttgattctaatttaattgggaccttgttgaagtttctttccagtaacgagaaagagtactctgtaacctggttatcttcctctactatccacgcaagtataatctcaatttacaaagcaaggtggatcatttctggatagtttaaaaaaatatttaaaacaaagatttttttggtagaatttgcatacaggcaagtctttaaatttggagtatctgcatattaataacagatttttctgtagcacactttttttttgctttttgagacggagtcttggtctgttcccaggctggagtgcagtggctcgatctcggctcactgcaacccctgcctcctgggttcaagtgatttttgtgcctcagcctcctgagtagctgagattacaggcatgcgccaccacacccggctaattttttctatttttagcagagacagggtttcaccatgttcgtcaggctggtctcgaacttctgacctcaaaagatctgccttccttggcctcccaaagtgttgggattacaggcataagccactgtgctgggactgaagcatactttaaataaaaatgaattgctggaataactttatagttctacagttctgctgagaatattgagtcctactttgttgtaagcatcattatttgtccccatggatgtctaggactgttttacacacttttgtgtgtctagaatttatcagaatcttggcacatgttatgtgctttataaatatttattaaatactgaatgataatatcaaatgaatcatgcctacaatattttcttgggccatacttcggcttgtctgacttcacaaggaattcctagtaacactaggggctaatcacctcagtgagagaaaatgtccctttctacttctcatttgcctcttcccaagccaagttttataagattcataaatcttagtcatatgtatacagtgaaaacttggcaagaattttttcagtaacctgttcctgaatcctgttgtttggatgatcaactgagtaatactgaacacacagcttctactgcccacacagtacacctgaataaacagtgattgttgtgatgtgtgttactgccttctatttgtgacctgctttctgttttgggatgtaaactaaccgagtggctttggcagacaaatatttagaagctgacatgccaaaataaccaaatcaaaccaaaccaaaaaaatctgtcacagaaatagacagatacagacaaaggtaatcagatttggaaaaatatcattttggttctcatttcataaagcccaggacaatgtagaattctgtgtatggttcgtgtctggggcctttgggggtgcatttctgcccctgtgtaatttggatgtcagaagatgaatctgttataagcaacatcactgcagattatagaatcacaaaactgctagaaatttaccaacaaactcatgtttatccttatttttaacttttctgttaatattcccaacatattttagtaactactcataccatatatttatggcagctggtaatatgttttaacagtggcatgcttaagtctacagggtaaagtaaaatactgagcacagataataaattgttaacttggttaaaccatatgaaattgccaatatttgactatttttgacctgtactaatggtgattttaaatcattcaatctaataagccaaaaaactacatttaagggtgtagaagggtctgttagcattctgtctagaatcttgctatttaatatgtgattagctaccagaagcatcaacatcacttgctagcttgttagaaatgcaaaatcttgagtctaactttagacctcatgtaccagaatgtgcattttaacaggctccctaggcagttcactttcacattaaaatttgaagcagaattctagaagaatggatacaactccacagagagttatagttaactatgaggcagatgttaaaaaatacaaatgtagtagaacagtagtttacagagatagttatgagttatttcccagtatttcaataaatttaaaatcttacttgaagttatgtatatttccaggtacctgcctgaatttcatgtcaccctggccattcagagaaagggaggtgaggaaggatggaggaagagtaaaacctcccaagtccttcacttaggtctcttgtactctggtgactcaactttcagtgtctcctgcctgccattcatctcttttattcatcaccaaccgcacccaagcccttgtcagagtctgatggctgcttccctctctgtcccatcaaatcctctggatggccagggtgttttatttgaaatacaccagtagttttttgcataacttttatacaacaaaagatttgtcctctagctttaataagtggctttttttcctactctaagaagcagcatgtgaagtaagtgggtactttgggagttagtcttggctatgtcctgctggacttgggcaagttatttacatttccaagactgtaatctattaaatgtggataacattgccttttcatggagttattgtaaattaaatgagatatgtgaatgtactagggacactggtgtccagtgttagtttccttttcttctgtggtttaagtgaagagggaaagaatagggaggaagagaaaggaggagagagactgtgactggatgagccacagtctgctttcctatagtaactatatacaactgtcttgatcaccagtgtatttctaatggttgacacagtgtctcttcctgaaaagtggttggcattaatatttgttgaatgaatacattaattttctgagggctgtctgcttgctttatgcactggagggtagaggaaaagttatatcacattaacttttcagcaggtcaaaaatgtgggttgcttaaattgaatgcagaatgtagagacagtggctaaggagcagacaagccaacccctgtggttggtgggaaaaacatacatgcagtgacaaaggacccaggtgaaactaaatagtgtccctggaaggttatgccaggtggcaactttagctccctaaacttccatttactgaatcccttgcattttaattcctaacctcatcttccttttcagccaaaataaattttctcaaactagagttcttgcggccagaattgatgtatagttgatggaagggaaaagaaaatctatgtttggaatataaaaatgcagtgacccttgggaggcttctgaatccatccctgtttgtatgctcagatggcatgacttgctgtctcttgtggcttacttaggaatgagtaacacatgaataatcagcccactgttccaatgagctacttgtacagtactccaggaacaccaggcatttcttacagcttttattctctaaatcacatgatgataaatgttgttgttttttatcctgagataactatgaggcctggggcaggatgatgatgatgacctgtgctaagagcattccttcctgtttcagtcttccagcaaccaccaagcggggatataatgatgctttacacacatctgataaaaattatgatagtgttttgcttctttccttgtagatcaaaagaagacctacaattactatagcacattgtcatttacaactgacaaactatatgctgagtttggcagagaggcttctaacaattttacagaaatgagccagagacttgaatcaatggtaagcaacttgtcatctacttctagtgcatttgctttcactttttaccatatttttagcatcctagcttctaaaagatccattcaactaacggatccctgtgtatttgcaaaatgaaaagaggccctaacccaaggaatataaaacaaaatggacaatacatcacttagcacaatatgactcacagggttgaaccaaagaaactttagccattcggtcaggtccttcttactcacctttccttagctagtgatatactcttgatcagtagagtccagagattctggaaatgtgagtgtggcttaaaatatatttgttgtatcctagacttcctaaaaaagagaccccgagcagaagattgccaagattgaaactatttaggcacatacctaaatagtctgttaggttttaaaaatatctaaccttcaaccagcttttggtatataaatctgtagtaaatccacagatatgcaactctacccagtttttaaaaatatttaaccttcaactagcttttggtatgtaaatccacagataagcaactctacccttaacgcatcaacattcatcttgagggatcaattaaatacttaagaaactggaaaaattagcagcatgggccaaaagaacaagggcctaagtggtaacttcttgtcattatcagattaattaaagaataatttaacttttcctggaaacctgtgaggtaattcatgatataatgtgatggaaagaacactgaactgggagctgggaggcacatgtatctccaatggtatctactaggtaatgatacatcacttggaatattagtttatcattctgcacaaagttctgtaaattgaaaattaaggtattaggttagataatttccaaattgtcttccagttccaataacctgaataagaatggaagtgagaccctggaaaccgcccagtagacagaagcctggggatttggccaccttgctgagacagtggttgaatcctggttacatttgcacttgcaaacaccaaatcagggaaatatttgaccaggctcttctctaaggctaaatacatatgcaaaatgaaggaaatgaaattgaattaaaaaggtcaagaagagatgccactatttcccttgttctttgtgccattcattcaaataaattttatttaagtaaataaaatccagacagatttaaatctaaaggaatatacataaggctctttaatgccttcaaaattaataatagttttgaagttacttgacaaaaattaacccttaaataaaaattttcttgtgaatactgccatcctattcagaggacttctgctattcagctttgtctcataatcgcaagaagtgtccttagtaaaaaaattcggaattaataaaatgtaagaaagaattaaaaggctcattgcttctgttaatcaccagcatgtagtaagtgtttactaaatatccacatactggaaacaagacacctttgagtgtttccttacataaactcctaattaaaaaattaagttgcctagaattcttatttagaataataactaacgtctctacaaaaatagactctttcactttagtagagtaaaactcataggtgtgttaggctaagtatcccagttcacctgggcctttctaagagcacttggagtgctgaacttcgtgtacattatgccaggaaaactgacaactttgtcactaggtttgggaagcatttgacatggtcatgcactcatttctataatccaagtattatgtggcagaattatttcatttcctttgtctatgggcagtaaaagtccttacttcagagtaaaatttctcactcttaattttgaagaaacagcatgttcattttctttggtctctttctgagcattagtacagcagatatcacttctggccccactgcggttccctactcctatcattcctaagacagcgttcagttgaaatcactgagaaaaccacaatagattcctcaagcttcctcagttccactcactgtgaaatgtcaatgttttttgctctgttttgttttttaattttctaaaaagctttgaattaatttgtggaatttcagaaagttgttcttgctgatatattttgaatatttttacaaacaggtgaaaaatgcattttataaatctccattaagggaagaatttgtcaagtctcaggttatcaagttcaggtatgtaaatctgaattgctgacttctgaatttaaagttgaagctgttaatctgctcagcaataaatatgttttcaagtgttaaagatataattcaatccaacaaacatttgacacttgtcctgtgtaagtcatgggttacaaagtcccttattcattccttaaatcccaaagtaagcatttgcaagatggttgctggggacagaggtataattggtgcctatgttataaaattgttttctgggaaacttaccaagtacagatagtactaaatacagatagacctaacacacatccttggtttaatggcaagtagtgccccatgtaagacaatatagtagatcaggtttgtctttagctcttcttcctcctattaatcaatcttctttatcttcttctattccatccctccattctcaaaatatgtagctgagaaaatctcatctgtcaactaactattgataaatgggtttagtacataatgttaaggaaaatattataagaattttcaataagatattgacataatacaaattatttgtattaaaaaacagaataagaattatttccaatattattccaatgacaaaactttaaaagtttcctgccattctattacttagctgatatctctaaggcattactttgatcactgtcttctaaaaattctgtactctctggtgtttgagatactgccctttcttggatctgcaactacttctcttatctttaagtttcactttctcaaagggacctcattcacccacatggtctcatatgctattgaaatacaagtttctatctctagtctgaactatttttctgatttctataactatatacacatccccatgtggaagttccacagaaaattccctaactcaggaagaatccaatcacataaatgagaaacctggaagtcatcaaacactccttcctttcctggtcccctcatactttatgaataactaagttccactaattctattttcccaataactttccaatttgctcacctctttattccagtaatcttgctactgctactcattattctgtcttctgttactgcaatagtgagaagagcaagtttattggaaagatgaagtcaattttggagatgttgaatttacattctaagggaccatatgaacctgaaaaatgagggtgactcagtagagggaaatggaactgagcagaagatagaaatttgctcatgatcaactcaaaaatttggaagcatgggtgtaaatttctcagaaaaagaataataaaagggaatgaaaaggatgacaaagaaagcttgaagaccaatatttaaggtgatggaaggaatataggaaacttagatatagggaaagagcaggaaaatagaaaaatcatgacagaatcaccactgatgcaaaagataagaagtttcaaagagagtgtggtcggcattgacaaatattcctgactgagtaatataaatattgaaaagaatccactggctttgtcaactaggatacttgggttgttacttattttcgtgtcctgaaaatagtgttacaattaacatgtttataggtatgtccttgcacaaatgtatgagtgcatttgaatgtttaatttctagaagtggaaatgctgtgccagagaagacagatattcaaacttataatagataacactgccatccaaaaataagactctaatttgtattcccacttccagtttatgagagtagtggttgatgcaatatatagtgaagagttagattcagaagtgactatgaaaaggagtgggtaaagtagctggcaggatgattccaaggtagtaattcatacaaatagtattaagactaattaatgctctgtgttgaaaatacagtcacatgaagtcagtacaatttggtaaagcggtcttatatctttaggattaggagttgtttaggatagcctgaagattgtttaggggaggtaagtagacttgagtcacaagaataaaacctgaaattcaaaaccacagttgatttcatatttaagacacactgtatttgataattttgaatggtttttgacaaggtgtctttttatattaatagccatatacttaactagaccttttgatggtaagggagaccatgaacagactaactcactatatgagaggctgaatttgtggttcttcacatagtaaacagtagcaatatagaaggaaacatttatggatgtattttatgtgtgcatttcatgtaagtgataaagaaaaaagcagattgtgatattacccttctttcttttcttttctcttttcttttctttctctctctctccctctctctccttcctcccctccattcccttctcttcacttcctttttcctttcccttctccttccttccttttctcttttctttctttcctccctccctcctttcttcacttcctccttccctccctccctccctcccttcctgcctttctttcttcttttcttttctttctttcattttcttcttttttggcccacagtcaacagaagcatggagtgttggctcatatgctgttgatttgtagatttcactctactgaggatcctgaaactgtagataaaattgttcaacttgttttacatgaaaagctgcaagatgctgtaggaccccctaaagtagatcctcagtcagttaaaattaaaagtaagttaatttctcttatttttctttcatagaacagcttcatgttaggtttgatcttggcacttattaaaaaattttttttgatgtcctttaattctggggtcttgccaccaacagtatatttctttggaactaaatttgtcctaatgaagtattttaatttttaagactaccctaaacttaggcctcccatgcaagctttttattaactccttagcagttttctttatattacactttatagtttggctatagaatccaattataagtgaagaaaatggctttgtattttcttctttttcttgttgctttcattgtatgttctgagggtgtggtatatggaaaggttcatgccatttacacatttgttttcaaatgtcattaatataccttgctatactttcttcccttaaacttttcaccagtgaaacatttataataaacttatttttggtatatttacaactataaatgaaaaatttaggtagatttttgttgttcttgttgttattgtttgtagggccacatgggacaaaacaagtgatgataggtcctcacatttagaaaataagaaatatgagatcctcagtggaaattaagatctggctaagggctggttcatatgttacagaacaatgaaggtctatagaaatactatctgggcacaagtataatgttacattttctagaagttacattaaaaataaaaataaacatgtaaaattaattttcaataatttgtatattcaacccaatatgtccaaagtattatcatttaaacaaatagtcaatgtaaaaattattcatcaaatatttcacttttttttgtagtaaggctctggaatctagcgtacattttatactgatagtacatttcaatttagactagccacactgcaaaagctcattggccacaggtggctagtggatacagtagtggatatggcagcactggaaactacagagtaggggacaagtagagagaatgaatacaaactgctaatataatatctgatagatctaagtagatgcctaaattgatggccagccaacccacttgcttaggaaggaggcttcagtagtcagggacagatacataatttatgcgccttagcacaaaatgaaaatgctagacctgttttcaaaaagcaagaaaaaagtgctgttaaaagtacaaagatataacacttttctttcttccctggtctcgctctcgactttccatggtgttttcatttgctgattattgtcattctaagagaaaaaaattaaatttgtagattactaatatgagtttaattgtttatatcatgcaatgtcgatataaatgcatatataagtacatttaacttgtatttcaaatcatggaaattatgcaactatatttcgtagcttatacatacatgtttttcatttttgcctcaatggaaatagtacaaaaggctaatgactctttttattttcctggttaatatgagaaaattctaccaacactctctaccttcagcttattgaggggtgaggaaggactagaaggaaaaggagatctggatttccctatctttctctttctacattgtagttttcagcaaaagttgttggctaatacacagaagtaacagaagcaagaaaggatatggcaggatctgttgttcatttgtgtttattagaatgctattgtcttttctatgggttctaagcaagttttggttcaaacagaaaacatggcctccaaggcatgtcagtccacctctgcttacttaatggaagggatagcacacttaccttgtacttgctttgagtcttgctgaacccctgtggattgtgggtccactagaattctgatttcatagggaattgtgaatgatatatgcaaatggagtggaaagaaactatggacacacttattgcacatatcttgtctgccaacactataatccattatcctattgaacttcattttcaaaacacaagttacaagataaaattattaagaatgtcaagtgagcaatagcagagcattgtaccaagcacaaggccattgtgagtgtgagacccagtgcagatgtataagtcacacatgaagccagccttgtcagtgctatcaatactcagagcttgacattttcctaggaagagcttgagatagagaacaggttatttgaaacaaagagatcagaggtggtccttttaatattaactgagactaaattgtaaattcttccttatttttgccattttccccacaagtagccagaataaataaagtcagaaagaaggccttctagaatatagatttccacttcattcatactattaaatactaaagaaaaaaattaacactaatatttttgcatttagagcatccatccttccatgtacaaagaatagttttggtcattagaactctgctgagtcagaaagtttgagcttagagttttatgtatctattagctgggttagtgtttgcatagggtttgagactgactagtgagaagtcagcaagctaagaagtcattggctggagctaaatgacaatttgagggcagactgtcttttgaaatttgacttcaaaaagggtaacattgtttttaactgtgagtgagtacaaatttatggagatgctactcaggtgtgttatacaaatgggactaggcttatgagctcaatgatacaatctgaaataatggttaataaaggtattgttacatttggggaattaatactatggtttagagtagtatttcccatggaggggctgtggactctctgcatcttatttactggtataaaatccaaattcttgggcgtcattacaagctactgaattagagttactgggaaggtgaacaggagtttcattataaatatgcttcctatgtgactcttacccacattaaagtttaacacaccgttcacattctctgcaatgtgatgatcatcctatgtctatgacaagctatgttgccttctttataatctagagatactgttttataataaaattaagcagccttttagtatttgaaatactcggaggcatagtgtaactctgatgtgctgaccctatttgccatttctgtgtgtttcagaaatcaacaagacagaaacagacagctatctaaaccattgtaagtttaatatatttattgaaatagcattacctgaaggtaaaaagctaacactataggtcatttaggtttactttgtgttgatatcatagggacagaacacataaagtttgattaatttgtgtacagttcatggtactttatcatatcttggagatacattttattagtaaaggatagcaaaattgagataactttggagtggatgtatgggtgcctgtggcagatgtgtagtggaattgagttgtacagctgttaaagaagaggcaagaaatgtttacttatcaatgttctgtttgtaggtatctataagataaaacaaatctatacattgtgtttttcagctagaggcagaaactcattgtcactatatcctagataaaatcttcttgatgttattaatcctacggattaatacgaaagtgcaggaaattatcgggtcgtggaagagtcacagaaagtgcaggaaattatggggtatattttaataaaattactgaagacacatagataatatcttcacctatattataaaagtgctgagtctaggcctagcacttttcttctcctatagccaagtatgccaccatgatttacagtatacattcaatagttatggggttgttgcacattacatttctcttaaaaggtggaaaaatatgtgctactcaccagctcatatagttggttaatttctaaaatcaactaaacacaaaaccaaaagataatctcattacctaaatagcatatattctcaccaccaatatttattgggaacctaccatgtgctagcactgtgttagacaacaggcattccaaatggataagatataatatctctacctgaagcaccttatactttaatgggactaggtgcatgagactaattcatgaacacatcattcttaaacaacacttctcaaccaagggaaatattgttggccaagctatcatgccccactgtggcatttttgtcatgaatatagggggagggctactggcatctacagtggatctacagtatataggccaagatcttatgatgcacagggcagccccctacaacaaagaattaaatggttcaatatgttagtggtgctaaggttgaggaaccctgtcataaacaatgtcagtatgtatacatacacataagcacacatacagagtgtgtttgttatacacataagcacacacacagagtgtatttgttactattattattttggaagcaccaagaaagtaataactaatccagattggagacaggggagttagagaaagcatcctagagaggtaacaactgatttagattttacaaaatgaacaggagttagctaaataaaacattacagtttacagaaaggtaagagcatgagaaaacatttgatacttttggagcacaaagtagaagaaatatgggacatagtaacacaatttgatgtgcaaaacaactgctaattaatgcacccaccaatgcaccccccctctctcttttgcaggctgcggaacacgaagaagtaaaactctaggtcagagtctcaggatcgttggtgggacagaagtagaagagggtgaatggccctggcaggctagcctgcagtgggatgggagtcatcgctgtggagcaaccttaattaatgccacatggcttgtgagtgctgctcactgttttacaacgtaagtcttgaaccttgagaatgattgggagtgaacaaagtgcactgggttttggcaagaaaatacctcatgaattttgggagatatgagtttagcataaattaaaaataatgtgtatatcacaaaagactggatcatttgtaaacattagtaagaggttttaaagtctggaaatggaaatggagtcaaagtatatgtaaataaataatcttttgataaacacacaatagtttctcaaagaaagcaggaattttaaagtcatttttggatttgaatttgctgtcaaacaggagtgctctatctctgctgagtaccttaatcagagatggagtctggataggttgtaggtttgatcctaagggggaaatttcacatggtaagaaaaagaattaaatacgaagaattatgtaatgaagatatgaagaatttggaagtagcaagttgtataaatgaatagattgactaattatattgcaagaaatggaggacccttcaatctattgtcaaaatgtctatagtatataaaataataatactttgttaaattattgtgtggactttttggttttcagagaaatgtgtatatttctgggtggggtacatgagacacatagaatatattaatttctcttattctgtacagggtactttccataggtcccttggagtcattaatatacagaaaaatcaaaaagccttagcatttggagtggatgacttggcatatggagtggcatgtatattataggaaatggtggctttttcacctggtcagaaccctgagccttattatcaaattggaaagagttctatacatcaaaactataaaaagaaaaaaaaatctacacctgtagactaaattatttaatataaattattcgactggtagcatggtaaaaagaaatttattcttcatttttttctccccagatataagaaccctgccagatggactgcttcctttggagtaacaataaaaccttcgaaaatgaaacggggtctccggagaataattgtccatgaaaaatacaaacacccatcacatgactatgatatttctcttgcagagctttctagccctgttccctacacaaatgcagtacatagagtttgtctccctgatgcatcctatgagtttcaaccaggtgatgtgatgtttgtgacaggatttggagcactgaaaaatgatggtgagcgtcggaagaggaactcaagtaaaagttaaattggtattttatggcatttaagcaatgaaatgccattatgccaaaatatgttagttgtgtggtcatatgacctggaccaagtcaggccctaaaagtgaagtaaataacttggaaggcacaaaaattccttcctgcctaagttaatatcgagtaaattgctactactatatactacagtcatagtactgctaagatgtctgaaaaagcaaatatgtctcctagccatgaactttctttagagaattaaccagtttagagattagcaatcaataatatacccaattctgaagattggagaatcataaagccaccattctcccctactgaaatttccttgtaatgttaacaatggagtggacattatttagataacttgtggttctttcctaggcacccaactttttgctcaaagtagttaggaacaaattatcttcccaaatattattgttctaaacatatgtagtctaagattctgtatcactatctttttttttttttttttttttgagacagagtctccttgttgagacagagtctccaggctgaagtgcaatggtgcgatcttggctcactgcaacctctacctcacaggttcaagcgattctcctgcctcagcctccccagtgattgggactacaggtgcccgcctaatttttccatttttagtagagacagggtttcaccatgttggccaggctggtctcaaactcttgacctcaggtgatctgcccttctcggcctccgaaagtgctgggattacaggtgtaagccaccgcacccggtatcccccgcttttttttttttttttttttttttaagatggggcttctttctgtcccccaggctggagttcagtggcccgatcttggctcactgcaacctctgcctcccgggttcaagagatttacctgcatcagcctcctgaatagctgggattacaggtgcatgccaccacccccggctaatttttgtatttttagtagagacaggatttcaccatgttggccaagctggtcttgaactcctggcctcaagcgatcctccaatctcggcctctcaaagtgctgggattactggcgttagtcaccgtgcctggcctgtatcaccatcttattcctaatcatgaaacattttcttcaagtttataaaatatatgtatgtctacaaatacaaagacttttttttcttttaggttacagtcaaaatcatcttcgacaagcacaggtgactctcatagacgctacaacttgcaatgaacctcaagcttacaatgacgccataactcctagaatgttatgtgctggctccttagaaggaaaaacagatgcatgccaggtaaacagttttgcccattagtatgttgtgtaattttttgtttacttttctttgaaataattatatatctacaggaagttgcaaagatagtacagaggagtcacaacatctcacccagttttctccaatgattacatctcacataactatagttcaatataagatctgggaaattgacagtcgtacaaagtatgtgtctaattctatggcattttgtcacatctgtagatttgtgtaaccaccactacagttaagatgaagaactattctatcaccacaaagacctacctttttccctcctcctactatccctaacatctggcaatcactaatttattctccatctctataatttttcaattttcagaatgttatataaatagagtaacagtagctttttaaacagaatttaattttggatcatctattggtatttttggcttttttttgtagaaaaattttagtggttcctttaagttatatatatgtgtatataaatatatatttatttatatatacatacataacatcactgtctatgtgtattgaaattttactagttttggtggagtatagaataaaaaacttacttccccttaaatccctttgcttttccctctttaatattaaacattaacaaatataaacattaaatattaataaatataaatattaaatatttgctttatattttgagaaccacagaagacaatgttttgcttcaacagtcaaatgtaatttagaaaacataagaggaaaaggaaagactatttacctatggatttcttctttcctctttcctgattccttttttaaaaacagtcatttctgttttaggaacttcttttagccactcttttagtataggtatgctggtgaaaaattctcctagattttctttgtctctaacagtctttatttcttcttcattactggagcataatttagcactgacagttcttttctttcagcatttaaatcattgcctctgtgatttctgcaaggaatttgctgctattagaattatttttttccaatagatgaggtgtcatttcttgctgtgttcaagagtttgtctttagttttcagaagtttgattatgtatcttggcatggatttctttgggcttatcctgtttgaggtttgctcagctttttgaatatgtagatttatatcctttgtcaagtttgagaaattttcggtcattatttcttaaaatactctttcagtcccaccttctttcttctttccttctggaactctaaccacagcaatgtttactcttttattatagtcccagagtttcctaagcttttgtttattttttttgcactctagtttctctctgtttttgagattgggtaatttcaatgtatcttcaagtttactgattctttgctctgtcttctctattcttatgttaagcccatccagtgagttttgaattttgcttatcatattttttagttccagggtttttctttgtttcttctttttatatttactatttctttgttgacacttcctatttcttttcctttgttttaaacatgatggtaattgctcattgagatgtatttatgatggctgctttaaaatctttgtcaaataatttcaacatttgtgttatctcagtgttggtatctgttgattgccttttctcattcaagtaaaaacttttatatttcattgtatgatgactgatattcagatatatgctgagcatctaattattatttattctgttttgttgttgttgttatatcatgcttttaaatttatattattttatttaattaattactttgcttcttccaacttttattttaggttcagaggttacatctgcaggattgttacatgggtaaattgtgtgttgctggggtttggtgtacaaattatttcatcatgcaggtagtaagcataataaccaataggtagtttttggttctcatcctcctcccaccctcaaccctcaagtaagccccagtatgtattgttcctctctttgtgtccatatgtactcaatgtttagcttccactcataagtgagaacatgaggtatttggttttctgttcctgcattcatttgcttagtataatggcctgtggctgcatccatattgctgcaaaaaccatggtttcattttgctttctggctccatagcattccatggggtatatttaccacattttctgtatccagtccactgttgatggacattttaggttgattccatgactattgtgacaattgctgccatgaacatatgcatacatgtgtctttatggcagaacaatttgtattcctttgtgtataatatacccagtaatgggattgctgggtcaaattgtagttctgtcttaatttctttgagaaatctccaagctgcttcccacagtggctgacctaatttacattcccacgagcagtgtataagcattcccttttctccacaacctcaacaacatctgttgtttttttgactttttagtaatagccattctgactggtttgagatggtatcttattgtggtttttaatttcccatttccctgattagtgatgttgagcatttgtccatatgtttgttggctgcttgtgtgtcttcatttgagaagtgtctgttcctgtctgtattaggctgttcttacactgctataaaaaaatacctgggtcgggcatggtggctcatgcaggtaatctcagcactttgggaggccaagggaggtggatcactagagctcagaagttcaagaccagcttgggcaacatggggaaatcctgtctctgctagaaatacaaacattagccaatgtggtggtgtgtgcctgtagtcccagctacttggaaattatgaggcaggaggattgcttgaacccaagaggtcgaggctgcactgcacccactgcactccagcttgggtgacagagcaaaaccctgtctccaaaaacaaacaaacaaactaacaaaaccaagtaaacaaaaagccaatattaggtaatgtataaagagaaaaggtttaattggcttatgattctgcaggctttatgggcagcatggtgctggcatctgctcggtttctagggaggaagcttacaatcatggcagaaggtgaagtgtgaaatgggagggagcaggtacatcacatggtgaaagcaggagcaagagggatagagtggtaggagaggtgccatacacttttaaacaatccgatctcacaagagctcactcactattgcaaagataactccaagccgtgagtgattggctcccatgacctgaacacctcgcaccaggtcctaccttcagcattgggggtgacaaagcaacatgagatttgggcagggataaatatccaaattatatcattctgctcctggcctctcccaaatctcatgtcttctcacattgcaaaatataattatgccttcctaacagtccccgaaagtcttaactcattccgactttaactcaaaaattcaaagttggccagatgcagtggctcacacctataatcccagcattttggaaggccaaggtgggtggatttcttgagcccaggagtttgagaccagcctgggtaatgtggcaaaactgcatctccacaaaaaaaaattagctgggctttgtggcatatgcctatagttccagctgtttgggaggctgaggtgggaagattgattgatcgtgggaggtttaggctgcattgagctgtgatcgcaccactgcagtccagcttgggtgacacagaaagacttcattttggggaaaaaaaaaaagtctgaagtccaaagtctcatctgagataaagcaattcccttccacctcatcaatctggatttcactgtcgatgtaactatcagcattttggtcacaaccatttaaccagtttctaagaaatttcagacttgatcatatctgtcttctgagccttcaaagttcttccatcctttacctgttacccagttgccaagtcgctttcacattttccaatatctttatagcaatgccacactcatagttaccaattttctgtgttaggctgttcttgcattgctattaagaaatatctgaggccgggtaatttattagaaaagatgtttaattggctcatggcttttcagactttatagtaagcctgatgctggcattaacttggctcctagggaggcatcaggaagcttataatcatggtgggaggtgaaaggggagcaggaacatcatgtggtgaaagcaggagcgagagagagagagtgggaggaggtgccacacacttttaaacaaccagatatcgtgacagttcactcgctatcgcaaagacagcactatgctgtcagggatccgttacccaaacaactcccaccagcctcacctccagcaatggagattaaacttcaacatgagatttgagaggggacaaatattcaaactgtatctatgttttttttccccattttaaaagggagttgtttgttttttgcttgttgatttgtttaagatttcttaaagattctggatattagacctttgtcagatgcatagtttgcaaatattttttcctattctgtaggtcgtctgtttactctgttaatagtttattttgctgtgcagaagctctttagtttaattagatcccagttgtcaatttttgttttagttgcaattgcttttagagtctttgttataaaagctttgttaaggctgatgtccagaatggtagttcctaggttttcttctagagtttttatagttttaggttttacacttaagtatttcaaccatctcaagttgatttttgtatatggtgaaagaaaggggttcagttttaattttttgcatatggctagccagttatccccagcaccatttattgattagggagtcctttccccatttcttgttatggtcagctttgtcaaagatgagatggttgtagacatgcagctttacttctggcttctctatttggttccattgatctatgtgtctattttttttgtactagcaccgtgatcttctggttactatagctttgtggtatagtttgaagtctggtagtgtgatgccaccagctttgtttttttgtttaggattgctttggctattaaggctcttttttggttccatataaatattacaacagtttttactaattctgtgaaaaatgacattggtagttttataggaataacatttaatctgtaaatttctttgagcagtatggccattttaacaatactgattctttctattcatgaacacaaactgttttaccatttgtttgtgtcaactatggtttctttcttttttttcttgagacaaggtcttaccctgttgatcaggctggagtgcagtgccacaactatagttcactgcagccttgaactcctgggctcaagcgatcctcccacttcagtctcctgagtagcggggactataggcattcaccaccacacatggctaattttttaggtttttggtagagatggagtcttgccatgttgctcatgctggtcttgaactcctgagctcaagcaatcctcctgcctctgcctcctaaactgctgggattacgggcatcagccactgtacctggccttcaactatgatttctttcagcagtgtttttaattctcattgtagaggtccttcaccttcctagttagccatatgtctatgtattttattcttcttgtggcaattgtgaatgagattgcactcttgatttggctctcggctaagatgttattgttgtatagaagtgctcctcattttagtacattgattttgtattcagaaactttactgaagttgtttatcagttctaggagcctttgggcagagactgtggagttttctgggtgtagaatcatatcatttgtgaagagagatagtttgacttcctctcttctatttggatgccttttatgtctttctcttgcctaattgctttggtcaaaacttccagtactatgttgaataacagtggtgagactgcacatccttgtcttttctggttcacaggggaatgcttctagcttttgcccattcattatgatgttggttatggggttgtcatagaaggcttttattattttgaagtatgttcctctgatgcctagttagttcaaggtttttttcttttttttctttttgagacagagtctcgctttgtcacccaggctggagtgcagtggtgcgatctcagctcactgcaacctctgtcccccaggttctagtgattctcctgccttagcctcctgagtagctgggattacaggtgccaaccaccatgcctggctaatttttgtatttttagtagagatggggtttcgccatgttggtcaggctggtcttgaacacttgacctcaggtgatccacacatctcggcctcccaaagtgctgggattacaggcaggagccaccgtgcccagacatatttatttattttcatatgttgaaccagccttgcatcctagaaaataagactacattactgtggtggataagctttttgatgtgctgctggatttggtttgcaagtattttgttgaggatttttgcatcaatgttcatcaaggatattgtcctgaagttttctctttttgttgtgtctcttccaggttttggtatcagaaaaacactgccttcataaaatgtgttagggaggcttctctttttctagaattttgggagtattttcaatataattggtaccagctcttctttatatatctggtagaatttggctgtgaatctctctgttccagggccttccctgttggctgtttttttaaaattactggttcaattttggaactcattatttatcttctcaggtattcaatttcttcctggttcaatattgggagtttgtgtttccaagaatttatccattccttctagattttctagtttgtgtgcatagaggtgtttacaatcatctttgaaattttttgtaaaaaatatttctcttccctttggcatttctgatggtgcttatttgaaagttctttcttttttttctttgttagtcttgctagcagtgtatcaatcttatctattctttcaaagaacaagttgtttggtttcattgatcttttatatggatttttgtgtctctatttcattcagttcagctctaattttggttatttttgtcttgtgctagtttaggggttcacttactcttgtttttctagttcctcgaggtgtgatgctacattgttaatttaagatatttatatcttttcgatgttggcattttgccccataaactttcctgttaatactgctttacctgtgtcccagaaattccggcatgttgtatctttattttcattaatttcgaagaatttcttgctttctgtcttaatttcattctttactcaaaagacattcaggagcaggctgtttaatttccatgtaattgtataattttgagagatcttggtattgatttctatttttattgcactgtggtctgagagtgtgattggtatgatttttaaaaatttgtttagaattgctttatggccaagtgcatggttgatcttagagtatgtgccatacatatgcagatgaaaagaacgtatattttcttgttgttaggtggagtgttctatagatatctcttaggttcatttggtcaagtgttgagtttaggttcggaatatctttgttagttttctgcctttataacacctttagaggggtgttgaaatctccactataattttgtatttatctaagtcttttttgtaggctctaagaacttattttctgagtctggatgctccagtgttggatgcatatacatttagatagttaatcttcttgttgaattgaacactttatcactttgttacaccattttttgtcctttttaattattgttttaaagtctgttttgtctgaaataagagtagcaacccctgttcttttttgttttttatttgcttggtagatctttccttatgcctttactttgagactatgagtgtcattgcatttgagatgggtctcctgatgatagcatacagttgggtcttgcttctttatccaatgggctactctgtcccttgtaagtggggcattaagcctgtttatattcaagttataatattgatatgtgaagatttgatcctgccatcatgttgctagctggttattccacaggcttgattgtatagttgcatatagtgtcagtggactatgtaattgtcttttctgtggtgtcaggaatttttttttttttttgagaccgcgttttgctcttgttgctcaggctggagtgcaaaggcgcgatctgagctcactacatactctacctcctgggttcaagcgattcttctgccttagcctcctgagtacctgggattacaaatgcatgccattacacctggctaattttgtatttttagtagagatgggatttcgctatgttggccaggctggtcttgaactcctggcctcaggtgatctgcccacctcggccttccaaagtgctgggattacaggcgtgagaaaccatgcctagccaggtaatggtcttttgttgccatgtttagcactctcttaaggactttttgcaaggcaagtctggtggtaataaattcccttaacatttgcttgtctgaaaaagattccgtttctccttcgcttatgaagcttagtttggctggatatgaaattcttgattggaatttttttctttaagaatgctgaatataccagcctggccaacatggtgaaaccccatctctactaaaaatacaaaaattagccaggcatgctaatgggcgcctgtaatcccagctattcgggaggctgaggcaggagaattgctttcacctgagaggcagaggttacagtgagctgagatcatatcattgcgctccagcctgggtgacaagggtgagactctgtctcaaaaaaaaaaaaaaaaaaaaaaaaagaatgctggctgagtataggtccccaatctcttttggcttataaggtttctgctgaaggttctgctgttatcctgatatcaccccctttgtatgtgacctgtcccttcgctctactgcttttaagattttttctttcatgttgaccttggagaatctgacgacaaggcgtctagaggatgggtgtcttgtatattatatctctggggttctctgaatttcttgaatttgtatgttgacctctgcagcaagattggggaaattttcaggaacgatattcataaatgagttttccaagttgcttgctctctctctttccttggggatgccagtgaattgtagatttggtatatttatataattccatatttcttggagattttgttcattaaagaatatctttttctttatctgactgagttgatttgaagaactggccttcaagttctaaaattgttttcagtttgatctgttctgctgttaatactgcccattgtattatgaaattcttgtagtgagtttttcagctctaggagatcagtttctcttcttttctttccttttttcttttctctcttctcttctcttcttttctctcagagtctcactcggttgcccaggctggagtgcagtggcaagatatcggctcactgcaagctccgcctcccgggttaatgccattctcctgcctcagcctcctgagtagctgggattacaggggcccgccaccatgccccccggctaatttttttgtatttttaatagagacggggtttcaccgtgttagccaggatggtttcgatctcctgacctcgtgatctacccaccttcggcctcccaaagtgctgggattacaggcgtgagccaccgcgcccgaccctgattctttcttaaaatggcaatttcatctttcagctcttgtgttattttattgatgccataagttccttagactgtgtttcaactttcccctgaatcttgatgatcttcattgacatctgtattctgaattccatgtctgtcatttcagtctggttatgaaccattgctggggagctagttcagtcatttggaggtaagaagacactcttgcttttagagttaccagagttcttgcattggttctttctcatctgtgtgtgtgaagttgttgtcctttgtatggagctttttacttttatattctttgatgccttttgtggtttgattgtggtattagttgtgcttagttaatttcattcgtttttggatgatttcaggggtccaagggttagctcagcactcctgggctgcatgctgtaccaggctgtaaccttgggaaattgggaccaggtctgaggcggttttctctagcccctagaggttaagtacctcctgggttggaaggaatgaggtgttcctggtccactggcaacaaaactgtgctggcaaaggcactttggcggggtggcagtgggtcagtgagggtccttgtgctcacatacgtgctggtggtggggtagtggcaagtcctgcacaggcatgcgtgctggtggtggggcagtgatggggtcagtgtgcatgcatacaccagtgagtcagtggctggaggctgcaggcaaaggcatgacagcaaagcagcaggtagaggctgccagtgagtgcatgctggtgggcgctcactgacagggacctgccttcaggagctctccagctgttaggcagggtctgccatcaaaatagcaatggctgtggctgtcaaaaaatgccttggctgggcagctgaggcagtgctgcaagtttgtgtagccaggcagggaatttggcataggccagcagacaagcgagtgcttggatcagattgttcccatcccacaagcaagagagccctgtgatgtccaggtctgtccatcaacaaaggcgaaagccacctagagatgtatgatatttgggggatgggcacccatgccatgctctgctgtagccattctcatgccaaaccctgtggactctgtgcaggctagaattctgtctctttcaactctccaggctgttctccctgccaccttaactgtccatgggggatgaggggtctcctgcagctaagattctggaggtctgtggtgtgagttggccactccatgaccatttaacttactccttccccaggagcctctccaggccaggaacaagttctggtgcttggcaaccctgtgcagggttaccagcttccttccctttcagcctggggtctgcattctccttccatcaactctcaatgccttctttctgaaaatttgttcagagtgtgccagtcttcttgatggtctggtccctcactgggagaaggtcttcttgtctgcgtctggtcggccattttgttttagtatttattaaataatgaaataataataatttgaaaaaattaaattattattatttaaaactctagatcttatttaaattttctatttaaccatgcctcagcagacattgtgatgcagagggagggggatgtatgaaggaattgcctcatttcccactcagcttcctttgatgctcaggtgagggactaatgctcattactactgcatggaggttaggcctcttctgataacactctggctgaaggtactttgttactgctccccttttggcctccactgacatcatggggtagtgatttcattactgcttcgcagtggtgaaagacttgacttcccactacctctcctcagacatggttctagtagatggggagagttattcctcattactgggtggtagttcatgcttcccactcagcatattcttttttttttttttttttttttttttttgaggtggagtctcgcttgttgcccaggctggagtgcagtggtgccatcttggctcactgcaacctctgcctcctaggttccagcaattctcctgcctcagcctcctgagtagctgagattaaaggcatgtgccacgacacctgactaatttttgtatttttagtagagacggcgttttgccatgtttgctaggctggtctgaaactcctgatttcaggtcatccacctgcttcagccttccaacgtgctgggattacgagtgtgagccactgcacctggtgcctattcagcatattctgacaccaatctagtagggaattgggccttcttacagcctggtaagcatggaagtcttttcagttgggatttattgtcttcctggatttgctgttttcccaagttgtcctcttattgattattttactagggagagcaggattttcttggagccttttaaaaaacttgcacttgttggcaggttgccaggttgctggcttcttccaagtccatgatatatgaagcaaaaaaaaaaaaaaaaaaaaaaaaaaaattgagagagctcactcttgtatcattccttttgtcctgcatttctgagcccacctgtcgtcttctctctaattttcagagtctttttatgtttgttttatttgtaatgcccaggtatttttttgtttgttttagccatatttagctggggaaaaaagaataagtaagtctgtcccatattggtctggagcgtttacatatttttgaagccgggttttgttttccagtgtttggctattgccaccaattttgtgcctttggtggatacaaaaattttgacctctatgtcttcatgtgcatcactcacaaaatcatggagggggccaataactggttccttctgtgtgtcactaaatgctttcataattttcattttgtgatttgacagaatttttgtttaatgtgctttctaagccctatagttctcttcagaattccatgttactctgtgtgctttctaatctgtattcataaaatggtaccattaatttctaagatttttttttacaatttttaatgttattcctttcatgctttcgcatgaacactatctgtattgccttcatttgctccacctcatttaattccctgttggcatcactatagttctttcccaacttttacctttgggttagtcgttttagcaatgttcagtttgctacattaaattcttttattcagttgacctttgtttatactctggcaaatgcccaagtttagactcacttcattttgtttctttttctgtgtttcctaattgctcctggaggaacacacggaacaaagtagattggtcccattaccacacactactaaaaattccttcctaacaattgaaattgattctgtaattcaatctcctgaaatgaattcaacttaaaagatgacttgaaaatatacttgatccttgttatttgcagattccatatttgcaaattcacctactcactaaaatttatttgtaacccccaaatcaatactcaaggcacttttatgatcattcacaagcatgcacagagtggcaaaatatcttattactcaatgagcatattcttacctgaggttgaaaaatgtgatactgtgcctttttgtttcagttctcattctgtaaacaagtgtcttttcttggtctacatagtgctacatttttcacatttttattatctttgctggcgattttgctgtttaaaatagtccccaactgtagtgccaaagtatagtgcaagaaggttgtgatgtgccatatggagaaaatatgtatatttggtaagctttgtttagttataagttttagcggtgtttactgtgagtttaatgttaatgaatcaacaatgtatattaaatagaacgtctttaaacagaaacacacacgaaatctgtttatgtcttgagcagttgacaaaaatgtgaccagagtctcctggaaaaccaaccctgtatttctcctaagaacaaggactcaacagtcattaattcagcatttgtggtgacttcacagaacacgactaccatgaataatgagaataacctgtattttatttgtcttcttgacggtcatggaatcattgatggtttagatattatgctagaccttcttttgtcctaatcatcatcatcctacttgcctccaactttcctgaaactgttgaaaacatcgtgcacttttacatttatgatcatccattattttctttattcaactatctcggtttctatagtctctatagtaatgtccttcctaaaaatttcagagaaacagatgtatgccctcttaatcttttattttataatttttattataaaaatttcaatggtatgcaaaaatagggaggataaaataatgaactttcatgtactcatcacctagttcaaaaatttacaactcatggccaaccttacgttatccgtacataccctgataaaatcccctcatcccctttccctaccaaaatatcaaatctattttgaagttaatcccagatgttatatactttcatctgaaaatgtccccattcaaaaatactattttgatggtgatattagaggtacacgctttacaaactttgtgagctacagaagagaagccaaatttgccctatgattacaatattctactttcttatctctgggaagacatggcacccatttttttgggggggagggatggagtttcatgcttgttacccaggctggagtgcagtggtgtgatctcggctcactgcaacctccaccttctggatttaagctattctctcgcctcagcctcctgagtagctgagattacaggcaaccgccaccacaccagactaatttttgtatttttagtagagacaaggtttcaccatgttggtgaaaaattccttcctagcttccaggctggtctcaagctcctgacctcaggagatctacctgcctcagcttcccaaggtgctgggattacaggtgtaagccatcttgcccagcctccatttaaaaaatgttcatgtctagcatccacagtttttaccacttgccttgctctttatattttaatatcacaaaaaccactaataacctcatatgtaaaaatttttccttgaatctcctactgtttctcatctcagtggtatttggcgaccttgcctttcttaagacatatcccttgtttgaatttcataattctgaaatttgctgatttctttcctcctcctccatctactcatttctggctgtatcctttgattaatctttctctctctctctcaatctggctatgctcaagattcagatctcagataaagtttttatctgctgtctatattctcactcaaagaagccatcttttctttgaactcagctatcaccttaatgagtgccaaacctgtgtctccagaattcaactcttgcccatatttagtcttacatttctacctacttcaaagtgatttctatttatatattttaagttcttaataggaaatgaaaatttgtatatgtgccatttgaaactcaacaggcatcatgaaatgttgcctgggtttttaagtttctcgctcatattattagggttcactattagagttttttttactcttatgtttcctccacatgtattcagttaagtcctagactattttcccactttaccatatcttttatgtttatttcttatgcccctattatttctgttaacaccctaatctattccctcatttctttgtgtcttaatacttccacggcttcctgtttggcttcttccaattttagaagtttctgaatacacttcctgttctgtttctcactaaaccattcactaaaaataacaggattaatgagacaaatagagatagagacagactggtccctcaaaagctatgcaactttataactgaagaattaacaaatataataattggtacctttaaaaatagcttgcacagtgtaggcaggcaaaacgcccaaggtctggtggcttactcagggcatgttaaaaatgcaaagaaaaataatgtggaaacacaggtttgctggtgctaaggcaatatacacagggaagtgtagtcctgagcagaagaggaaatgcaacctaaaactgatacaaagctaggatacatctctctggggagggagttttgggtacaggcactcaggcattttcttaaaacagtgccccaaatgtgtctgcctgtgtaatagctgagttgaaagggttttccttttcttctgaagtttataattccactcccattattctggctcccttgcctaaaaaaaagcatatctaaaccatcataatttccatcttctactgacataactctgccattcactaatcaaatgtgagctaattagtgctggtagaatagactctatatttttttctatttgatacttgctggacatcaccttacttttcagcttgtaatgctatttactgctatttatatactattatttatattatttactatttgtatactgctatctctttaaaataattatttattctcggactcatttattcctgtctcttatgctgattaaagctttgttttctcttgtatcttctatttctctatcctgattttctctgcctgcatatagacttgggattttattatcaaaattatttatttttgaatagcttcatatggcatatcttatttctataagcagattgcaggtttctagaggacaagatccatgtgtttataatactctttttatatctcctcctacatacgagggtatcagtaaatgcttattggttagttgatttaaaatcacaaatgtattatttcaaatgtactattatattagttaattttttaaatggacaaaagaaaattcacaaggaagttagcataacgtagggaaaaaagcatgggcttctgaattagatcgctctggattcaaattcggggtctgccactgattagcacgtgatctcaggcaaattacttaatgtttctgagtttcagttttcttagtaacccagaaaaaattaacctagttctatgttttttgtaaacaagaattacatgaattaatgagataatattttaatcaattaagaacttcatagagtgagtatgaatacttaatgggtggtcaataattagaagcgccaggatcttgaggaataatcagccagtacctcattattacaagccatataaagaatcaaaactctggagtttgcaggatataaataatgagaatttgtgattttatatatgcatttcctaagttctgccttttgctagactaagcactttacattcactgtcttacatcatcttcatagcactcatcacaggtaggtattattaggagcatttacagataaataaattaaaggtcttagccagcatggaaaggccaaacttgagatagaaaccctggtgtctgactctaatgtctgtttttttttgtttgtttgtttttttaaaatcagtaatagactcttcactcccttttttggggggttatgttacactaataaagagtatagacaaaataattagggagttattttgtcagatgtgtcacataagttaagagtacagttcttcaaagagatggaggcttcaatctcattgttttgaaggtttcaaggtatttcaaggtttcaaggtttcaatctcatcagttttcaaggtattggaggtcctcttttaggtggataactgacatagatggagaaaatcacttatgcatgcgaacacacggaatacttttgaaaattacccctttcattacattcttaagttagaaaaatagccaattcctctgtaatgaactgaattatgaattactaatttctgtcttctcctttagggtgactctggaggaccactggttagttcagatgctagagatatctggtaccttgctggaatagtgagctggggagatgaatgtgcgaaacccaacaagcctggtgtttatactagagttacggccttgcgggactggattacttcaaaaactggtatctaagagagaaaagcctcatggaacagataacatttttttttgttttttgggtgtggaggccatttttagagatacagaattggagaagacttgcaaaacagctagatttgactgatctcaataaactgtttgcttgatgcatgtattttcttcccagctctgttccgcacataagcatcctgcttctgccagatcaactctgtcatctgtgagcaatagttgaaactttatgtacatagagaaatagataatacaatattacattacagcctgtattcatttgttctctagaagttttgtcagaattttgacttgttgacataaatttgtaatgcatatatacaatttgaagcactccttttcttcagttcctcagctcctctcatttcagcaaatatccattttcaaggtgcagaacaaggagtgaaagaaaatataagaagaaaaaaatcccctacattttattggcacagaaaagtattaggtgtttttcttagtggaatattagaaatgatcatattcattatgaaaggtcaagcaaagacagcagaataccaatcacttcatcatttaggaagtatgggaactaagttaaggaaatccagaaagaagccaagatatatccttattttcatttccaaacaactactatgataaatgtgaagaagattctgtttttttgtgacctataataattatacaaacttcatgcaatgtacttgttctaagcaaattaaagcaaatatttatttaacattgttactgaggatgtcaacatataacaataaaatataaatcacccatttgcttgacattatgatatgataatccacaaagaaggggaagatgggaaaaatgttactagtcaatttattgtaaatttttttaaaatttgaggctaggatgaaaattaatttaataacaatcagcatgcttatgtactaaaataattgcgttgtggaatgggagggaacgaagagttcaaacaattgactggaaaggttttattcgtctaagactttcccaaacagcaaatccttgaagggaatgagatccaggtgttagtgtacagtctagtgatgcaactgaactggggctcagacctctattttgagatgattgtagatatttttcttcccctgctgctgtgtttacagttcatacatggttaatggtcctgttagactcctcttcgctgagatggaaagataccatagagaaaatatcctggaagctgcctcactgctgcatctagtgtgacactgaatggctaactgcctggataacaaaactgaagagtaaaagcatgatattggccaccttcatgatttttagttttggtaaattattactgagctgttagagacacagctttcaagtaatccagaccgtaatgaagttaggactggtaccatgatgtacggcatgttaatggtgagatttcaccaagtctgtcctcattgcatatagctactcatataagttctatattgtacaataattaccctgaaaaccagtattgccacgaaaaatttaagtttattgatctgaataacactggagtatgaactgataacatttaggcacttggcaaaaatatgaaaactgacatgaattgatagtgctaaatattttgcataagctatttttgtttcatttagcaaaatgctctgggaaaaaacaaaattgaggaaaaccttgaattttaagcaaggatataagtacctttaaaactactctcagtgttctgttaaaaatggattcctcttgtttcagtgtattctgtagttgggcctctaggtggcacccacaagctgtaggaagctatggggaagcctgacatcaagaaggatgtctagatctgtaagtaataatgagaactgtacctgaaattagagtctcgtgaaaccaaaagaatacagtttttctttgcaaatggcgtttaaaaattaattcgtgttgatttacatcattattcgtatttttcaaatttctggacatttgattccaaactaaaataaaatttatgttgcatgatttgaggaactccctctgcaaaagcacctggagcaatttaaattaagaagaaattttaaaagcttaattttgcaatgacatcttattcctaagagaaatacttttgatatttccttctacaaaggatttgagaaatagaagtttgggtcaaagtgaaaatatgagcgatagttcaaactttatgtacatagagaaataggtaatacatttctaaaatggtaacttcttttgaaaagtaattaccaaagggttttatctgcatgtctgtgttaactgtttcattggagatagttaagaagatgtgacgataatatttattacttttttcaagagggcaggcagttcctcttctatatcttcgatctctcttcctacagcactagtaaagtactctgtatataacagtccttcaataaatgttgttgaatgactcttttatttttacattatgcagaaaacatagctttattattatttacacattgatttttaaaattaatcccagattttacactgagtgaattaagccggttactatttatctaagcctataatctcacccgtaagatagagatgatatttgctcaaatgattgttgtggaaataaaactgtgaatgtttaaaaagtgcttagcacagttcttggaacattagtaggtgttcaagagaccatagtaataataactgttgctataatgaaactacactcttgttttaaaaaatatggtatttgattataacaggctgaataccttttttttttgaaatgacaagataattagaccaacaaaatgtgctagttaaaaaaatttctgattctacaaaaagttttactgggataattccgaaacatatttatcaaagtggtctgtcaatgtgagggttcattctaacttttgacttcaattttaaaaaatgataaactttattaaccaccgagtggctggattatatcaagatctatggtgtagttcaaatgtcgcctcttccctgaagcctttttttacttcctcaagtggatgtactatacgtttcttctgaacttccttaccattaattttttttattttcagataatcattgattcagatacggttaagatataactgtaagatataattcacagagattctgtgtaccctttactcagtttacctcaatagtaagatcttgcttaggtgtagtataatattacaatgaagaagttgacattgagacaatccattaactttattaggatgcaatcaattatatatgtgtgtgtaggtgtgtgtgtaattagttctatgtaatttaattacatatgtagattcatgtgattaccaagatacagatagtttgttcacaaggctacatcacgctaccgacagccatccagctccctccctaggcctgtgtctagtctctaatccctggcaaccactaatctgctctccatctttataatttttattgtttcaagaatggtatataaatatattatacaataagtaactttttcaggttggctttttcgctcagtataattttcttgagatctgtccaagttgttgtgtgtgtcagtagttaattctttttttattactgagtagtattacatgatagggctgtacctcagtttgttaactgtatacccactgaagggcatttggattgttctcaggttttggctattacaaataaagctgctatgaagatttgtgtgtaagcttttgtgtggacataagttttatttttctgagatttatggcctagagtatgctgggtcatacggtaagtacatgtttagatttttaagaaacggccatattcttttcacatggctccttactacttgtaaaactctctgtacttagaatatctacctgtgtatttcagatgtgcagatagatgtgatttcaacaactagactgtaaactccatgagggtggggacagtaactggttcatttttatatccttcacagttcacaggaaactataatattgtttatggcagttgttctataaagatttattaaataaaaataaagagtaataaaagcaaacaaataaatatacatgaaataaaaaagaagaaatggctttgggtagaaaagaatgaacagtatttccttcatgaaggtattactgctcaatttctgtaattctgcatggactctaccatggcacttccatgtatcttatgttggttgatataaagtctgtttttcacctttccacagggtacacaatcaaacatagactaaagacatggttgatatggagaatctctctttatatctgaatttagtttctgatacatgttatatttaagagttttctgacacatctgtatcagcttctactgtatttgtggaatggattccagtttaggagcacaatcaataaatatttgttgctcttactttttataactatgattctataatttgtcctaatgtaatttttattatataactcaaggtggagtgaaagacagagacctgtgaaatgtaatcagaagttctctcttaattgtccctaacacaataatcagtacctctttggcgtagatgtagtcagcttaaattttacaatcacagtactcactgccttgcatatacccctcacctgcttgttctcttgctccaccactctgtgacacttgctttttactatgatcctggtaaaatttaactctccacttactgtttttaaaaactaattaatttcccccaattttattaaagtataattggctaataaaaattgtatatagttacagtgtaaaatttgatgttttgatatatgtatacattgtgaaattatttaatcaagctaattaatatattcattacctcaatacttactattttttaaaagaacatttaatatctattcagcaatatctacttttaacaatttaaaaatactcaatacattattattaactgtagtctccatgctgtaaataggcctccagaacttatttcttctatataactgaaactttgtaccttttaatcaatatcttctcatttctaccacactccagcctctagcaaccaccattttactctctgcttctattagttcagctttcttagattccacatataagtgagatcatgtagtaatcagcactctgtgtttggcttatttcacttaacataatatcctccagattcatctatgttgtcacaaatgacacgattcccttcgtttttaaagctgtatcatattccaatgtgtgtatttctttattcttccaccaatggacatgtaggttgattctatattttggctattgtgaataatgctacaataaacatgagaatgcaagtatttctgtaccaaaagtgaaaaacagaatggttgtatggtacttaaagtatggtttctactgaatatttcaattaatcactgctgagataaccaaaatagtgtgtaaaaaacaagcaaatcagcaaaaccaaaattgcactttttcaaaatgtcagataaatgactaatcttttaactagactgaactcccataaaggagatgattcacattttaataataaagtcagatataatagtaaagacattattaccaatcatacagaaataaaagaattataattgtatattaggagcactggtatgtcaacaaattataataacttagatgaaatgaacaaatctctaaaagacacagtcatacagactcaagagttctaacacaattccattatgttcaaaggacacacttcgtatgatttcagtacttttattgagagacacggcctagcaatggcctatcttggaaaatgttaatgtacttgagaatattatatacagtcatgcattgcttaacaacagggatatatgaactgcattgttacatgattttgttgtgtgaacatcatacagtgtacttacataaatctacagggtgtagcctactacacacctaggctgtatggcataatctattgctcctaacttacaacctgtacagcatattactatactgaatactacagggaattgtaacacagtgggaagcatttgtgtatttaaacataactatacgtagaaaagttactgtacaaatacaatcatctaaaaaattaaaaaatggtatacctgttaaaattcttatcatgaatggagttttcagggctagaagttgctctgggtgagtcagtgagtgagtggtgaatgaatgtgaaggcataggacattattatacactaccgtagactttataaacaccatgcacttaggctacactaaatttgtaaacaattttccctcttcaatgaaaaattaactttagcttactgtaacccttttaatttataaactttaaatttcttttactttttgactcttttataatagcacttagcttaaaaacaaacatatttttcagccatacaaaaatattttttctttatacccttattctataagctttttaaaatattttaataatttattattttttacctttaaactttttggttaaaaactaagagcccaccacagctcagcaaggccactgtggccagactgactctctagattccctcctctctgggcagaacatctctgaaaaaaaggcagcagccccagtcagggacttatagataaaacccccacctcctgggacagagcagctgggggaaggggtggttgtgggcacagcttcagcagacttaaatgttcctacctggcagctctgaagacagcagtggatctcccagcacagcgttcaagctctgataagggacagcctgcctcctcaagtgggtcactgacccccgtgtatcctgactgggagacacctcccagtagaggccgacagacacctcatacaggagagctctggctgacatctggtgggtgctcctctgggacaaagcttccagaggaaggaacaagcagcaatttttgctgttctgtagcctccgctagtgatagccaggcaaacaggttctggagtggacctccagcaaactccagcagacctgcagcagagggccctgaatgttagagggaaaactaacaaacagaaaggaatagtatcgacatcaacaaaaaggatgtccactcagagaccccatcggaaagtcactgacttcaaagaccaaaggtagataaatccacgaagatggggagaaacaagtgcaaaaaggctgaaaatccaaaaaccagaatgcctcctctcctccaaaggatcacaactcctcaccagcaagggaacaaaatgggatggagaatgagtttgatgaattgacagaagtaggcttcagaaggtgggtaataacaaactcctccgagctaaaggagcatgttctaacccaatgcaaggaagctaagaaccttgaaaaaaggttagatgaattgctaactagaataaacagtttagagaagagcataaatgacctgatagagctgaaaaacacagcaggagaacttcatgaagcatacgcaagtatcaatagctgaaccaatcaagcagaagaaaggatatcagagattgaagatcaactcaatgaaataaagcaagaagacaagattagagcaaaaagagtgaaaagaaaagaacaaagcatccaagaaatataggactatgtgaaaagaccaaatctatgtgtgattggtgtacctgaaagtgatggagagaatggaaccaagttggaaaacactcttcaggatattatccaggagaactttcccaacctagcaaggcaggccaacattcaaattcaggaaatacagagatcaccacaaagatattcctggagaagagcaaccccaagacacataattgtcagattcaccaaggttgaagtgaaggaaaaaaatgttaagggcagccagagagaaacgttgggttacccacaaagggaagccaatcagactaacagcagatctctctgcagaaaccctacaagccagaagagagtgggggccaatattcaacattcttaaaaaaattttcaacccagaatttcatatccagacaaactaagtttcctaagcgaaggagaaataaaatcctttacagaaaaggaaatactgagagatttttgtcaccaccagtcctgccctacaggagctcctgcagtagtttctgctgccttttgttcagctatgacctgccaccagaggtggagtctacagaggtaggcagggctccttgagctgcagtgggctccacccagttcaagcttcctggctgctttgtttacctactcaagcctcagcaatggcgaatgcccctcccacagccagtctgccaccttgcagttctatctcagactgctgtgctagcagtgagcaaggctctgtgggcatgggacccgctgagccagggccgggatataatctcctggtgtgctgtttgctgagaccattggaaaaggtgggagtgtcccaattttcctggtagagtctgtcatggcttcccctggctaggaaatggaaatcccccaaccccttgcacttccagggtgaggtgatgccccaccctgcttcagcttgccttctgtgggctgcacccactgcccaaccagtcccagtaggatgaaccaggtacctcagttgaaaatgcagaaatcacccatcttctgcattgatcatgctgggagctgcagaccagagctgttcctatttggccatcttggttcttcactatagacatgttacaaaggaagatatacaagcagtcaacaagcatatgaacaaaaagatcaatatcactgatcattagggaaatgcaaattgaaaccacagtgagataccactgatcattagataaatgcaaatcaaaaccacagtgagatactatttcacacaagttagagtggctataattagtcaaaaaatagcagatactggtgaggttgcagagcaaagggaacacttatacactgttggtgggagcgtaaattagttcaaccattgtggaaagaggtgtggtgattactcaaaaagctaaaagcagaactaccatttgacccagcagtcctgttactggatatatgcccaaaggaatatatatcattctaccataaagacacatgtacatttatgttcattgcagcactgttcacaatagcaaagacatggaatcaacctaaatgcccatcaatggtagactggataaagaatatgtggtacatatacaccatgggatgctatgcagccataaaaaagaatgagatcatgtcctttgcaggaacatggatggaactggagaccatcatccttagcaaactaacacaggaacagaaaaccaaatgctgcatgtactcacttatgagggggagctaactgatgagaacacatggatgcaaagagacaacagacactggggtctacttgagggtggagggttggggagaagaataggatcagaaaaaataactattgggtcctaggctttgtacctgggtgatgaaatagtctgcacaacaaactcccatgacaggagatcacctatattagaagcctgcacttttacccctgaacctaaactataagtttttttttaaaaaaaatcttaagaaagaaacataaagtcaaacgttttgtgaatattatgtcaaaattatgtgcttatcattttgctgctgttccttttttaaaaatgctttttttatctctctgtaaaataatggtgttccctttctaatgcaaacatactttcagatcctaatcatcggggtaaacattctttttaaaactattgtttacaaaagtaaaaatctgactttgtccatgcagatcatctattgacaagtatttttcaacaacataattttaaccttatgacatcagttttaatagcagtcattacactattattccaggtgattctgggacacctgagtactctgtgtaattgaagttatctgtagccacatttaatatgacatgttcaatgtttggtctcacaagctcactgcttagagtcttcttcatccacccaatattgaagtaatgaaatggctgttaatagattcatcactgatctcattctgcgacatctttatcagaataatataaaatcaatgtaagaaatttggtgaaattatgaaaatttaggaaaaaataaatttcatttataaaatctgtgtgctttcattatggttttattctatttatataactcaaagtacatatattatgtttacataaaaattttttatctcattgcatgtatcttttcttctgacacaaaaattgtgatatttttctgttcatcattttgttccgtagtattcaacaatacctgtactatggctgacagtgtaatttaacattttttgataaaacaattgtaatgacatggtacacacattgtatacattttaaatcatttctcaatgtaaaatatttgaattgtctccagtgtttattttatgaatgtctgccacaaatattgaatctgaccatcgtgatttaggtgttctctgtatagtttcatatgagtatattatgaagccaatgtctatatgcatttttataatacttaatacttttccccaagtgtctgattcttttaaaatatgcaatcattatctgagaatctaatacataatggaaaagcaagaaaatttgtgacaaaaattattttatgtaagaaagaagtagaggacaggctgcacaactattgacctggattcgaacctaccttctgcaaatgaataacaacagctagtattagtatttatcactattgttctaatagtcattcttgcccttgtcttccttctccacctactctcttcccccttctaatggcaccatcactttcctctaatgtgaatgggaaaattttttgagaataaggttagagtgcatagaattttcattggtcttacctctgcctttgtcctttgggaaattaccacatagagcctatgcaattttcattcaacatagacattgagttttaactcaagtaagatttcagttttctgttgctgcttataagaaggtagacaaaaagatctcttaaggcttatataataaagtagtgaggaatgcttgctttctgcttatgtctcaaaagaataacattaaagtaaaatatatgaggttcttttgtttcttcgtaaggaagatcatcctatatcctgacagaattcttttgtaaatctcagtgtagttttcagatgcaagtggtagacattatttggatcttattatacatgcattgttcatttttttttggtgcttctctgtcaggcagctgtgatgatgagtcccaagtttcccagagatttttactgaggtgtcctataggcgtggcataaggcagaaaacattaaaaggttaaactgacccttttatgctctaagatataaacctctgtgatctcactgacgaaagttttaaatgctagagtgaaagcaagtaaacattggctttggctgagaatattctggtggcacacatttatgtcgttgatgaatagtgtaccttgaaaagccttaacccttacatcgttagcatttcatcttgttcatctgactgcccaaaaatctatatttaaacaagtccacaggggatctgttctctaggactttgctggagaaccttgatgtgttggaaaactgttcctattaatagaaaaattatatctcgagtggctggcatatgttaactaatggatactattaatagtaataacaaaaataaaaaatcattacaatattactactatttgaatcactatgtacgagagacattataagtgttttatctgtattaagtatattttcaacacaacacaataggaagaaattgccattattatagaagtaggcataattatctctatcaacattctagtccacttttccattatctgttgcataaactcatgcaaaatcttctaaatgatctacgcttttcacaatctggcctttttgtgatgtaatccattgacaacattgagagctttttaaagaaagggaatctgatcacatctctccatttcttaactctgtgcagtagctccccattgcccttaatagacacttcgatctccttataattatattgcttccacttacctctctagcaacatctgctactttactcagctttttcctgcatactaattagaaatcttaggaactgcctttacttcactacctgcttttctttttttgttttcctctccccctcttcttttcacctattcctgcacattactgaggactcactttaccaatgactttgagatctcttctagatgtttgcttagcattgtgaccttataacacttttagacttttcctttttacttgcttatagtctatctttcaaagtacaacgtaaggcatgagggagcagaaagtgcctacatttcttctctgaaaatcgagcacttatccatggtttatgctgatcacttcataaacattctttgaaggaatgacttatactttttttttactttgcacaatgaaggctttcattgaatcaaccctgttttcagagtctctttagtatccctctttgatatttaatgacactaaagtttacacagttgtgatgatatagaaacatatgagtttctaatggtaggtcactttactcgacctcccatattttctcttactgtgagtcaaacactctgaataaaaacatatctggccattccttctgaaatgcaaagcaaacaaatcaaacaggagtaaatttaccttaggcagggttttggctggtttacagtggagttcccccacaaaatcgacatttggtaagggtgggcaaagaaattcaaaatcccagtacgtttgaatgagccacacttcagctttccccattatctgaaataatgtacattaataaaataaatgtatacatatctttttatatataagcataacaattttcatatattgcatgttacttatatataaggaaagcaaagtgttcagataattaagaggaaattacatatttaatgtaacataagtatattcacaatcacaaatagttattgaaataagccactatggacttaaatatgcatttgtttcctctctaaagttgcagtagtaaccaatatagatttaaacagctctttgagctccacgattaattcatcttactatacttataaaaacagctttctacaaagcacaaaatctagtttccacaatttatcaagtcagtcccttgatccttggttctccaagtgaactgtgagttttctgagagtatggctgaaatccttgaacatactactgcttctagttcatgttaagattttaatgatattagttgtaaaatacatacatttaaaaatgatagctagtatatattcagaatttattgaaacagagatatgtgctcccccttaacttggcccatattttccctaataaagagaagtagttcaataaaatatagattaaaagcttgaatgttcactttcaacaaggtttcagttcacaaagcaaataatttccaagttgttagtgaactatgaacaaacactagaaacctcaaattttaggtttctgtttctgaaatagagccagtatacctctcaactgtgaaggaatccttctgtttatagagaaaaatattttaatacctaaataagaaaagtgaggtacacaaagagaaacaattttctcaatgctgcattaatagttatgctagaaatatgtgtagctcctcatctaaatgtctgccttcatcaagttgtttattgatatatgtattgccttttttaaagatgaaaaaagtatagtaaaatacttatatagttgcttaaagaaatcataagtgctttactttgtagttttttttttttaattcctgtagtgtcctataggagcgatggccaaagggttctagctgagcctataatatcaacatttctataatatttgtgagattgatagatcatcttacatttgccattcatcatttcatttaaacaacactatcttcttacattatatttatatacgctcaccttcaaaggcaaaaggaaagttagaacttattaaccattgattagaaacatgacttacctagaacttcactgtaaaacttctcccacttctcgtatcaaacatttgaaaccaaaagtcaaaataaagcacatgtattaaatttttaatcctctccacgaatgtcattttaccacttaattcagacagaacagcaggtatgcgggaagtggggaatagaagtcctccactatacttctcaagtgtgtagccaggagactgtcaacaaaggacatgtatttaacatgcctttaacatgctcagctagcagttcaccacaggcaccaagggcatctgcaagaacgacatcaaacattgactcttgtagttttgtcgtaattttcttgttcaaaactacatctttacagagattattaacacagtctgtagattcccaaaagagttcttgtgcttgtgagaaatatgaccaaaatgcatctttctgaagatcgtatatccatctattgatcagtttcacaacaagaccctcaaaattatttttaattagagatgttggataaacctcaaatctaatagcagatgatttactagggtgaataataatggaagccaaagatgacagcacagtcatcttatggcctctccaaacaagttcatccaggattgtctttatattcatccaatggctgtattctgtgggccacactagcacctttccacaactcccagaactaaagtgacaactgagttgtatcaggagaatatttgacatcgatttcatagttctcctggtgcaatgcaatgcttcttttcaaatcgctgtttctttctgtttttctcctacttatatctgaagataaatcaatcaagtgaaagtataactgctacaattcaaagtagtagttaccatataatttctaaattaccataggaattgtctgttaccatataatttctaaattaccataggaatttccagattgtttttcacagtggatgcttcaatttccattctcaccagcaatgtataagaattttaatttcttcccaaccttgccaacacttgggattatatttcgtttgattatagccagtgtgaatgaagtgatatctggttatgctttacctttctttgatatgaaatcatgttgagcatgttttgcctaattttggttgaattatttgtcttcttatggacttgtgtttttaatatctttctgatataagaaccttatcacatatatgatttccttgttttttttttattctttgggctgtccttttactttcttaacggtgttcattgaagcacaaaagtattgattttgatgaagtccaactaatcaattttaatttggttgcttttatttttgattttatatctcacaaaccatttccaagttacaaaaattagtacctgttatttattattagagttttatagttctagtgcttacatttaagtttttgatcacctttgaattagcttttgtaagtgatttgaggtagagggtcccaactcaattattttgtatatggataatcattattcccacttatatttgttgaataatctattctttcccccttaaatagttttgaaacttttgtcaaaaactttaaatgcatgggtgtatttctatattctaaaatccattccattgatctacatgtctatctgtaggcctgtatcacactctcttgattattgtatatttgtatttgtctttaaaagcaggaaatgtaagttttccagctcatttttattttaaattgtttcagttttttaaaaaatttttttcttcttgctttttttctttaagaggtagaggtgttactatattgcccagactagattcaaatttctgggctcaagcaatcctcccaacacagcctcttgagtagctggatttacagatgtgtttcactacacctagcttcttttggctattagtatgtctcttgaatatgtataaatttcagaatcagcttgtctgtttatgcaaagaagtgatctgggattttgatagggattgcattgatttggtatatgaatttggggagtagagtatggtaattatcacaatattaggtctttcaataaatgaagatgtgatgcctttctatttatttagatgttcttatttccacagcgttttgtagattttgttacagtggctagctagtcagacacaaacagggcagaagacggctcccacaccctaccaggaaagtcagatgaccatcagttaatggtcaggcagttgtcacactgtctcgctaaaataataattggttgcagccagccagagaaaggcagctttcctataaatagaaaaaatcaaatctggtaatcagcagcttcctgataagatctcaggagttgggtgagtgggctcacgcatgcacattaagaggccaaatggtggagtaagacattccggtggcaccagaaaagggaagaatgcctcaggggagcattcatatgactccagtaaacatactgtgcatactcatctcctaagtgctagcaggccatcacacataccagcaggtcaccctaaggaaagaatcaaggaaaatggaagcaggatcctggaagtatgccaacatataaaaccctaagtcaaaggtcaaacactgcactttaccttcaaaatggccacttggatataccccaagtgtactttcctttctttcctgctataaacctttttaataaattttcacttttgttctgaaacttgtcccggtctctttttttgccttgtgcccctcaatcaaattctttcttctgaggaggcaagaattcaggttgctgcagaaccacaaaaatttgctgcagtaaccaccactagtaataatttcacagtgagagttgtacaattttttgttaaacttattactaagaattatattttttcatggtattataagggtgattgtttaatcttcattttagtttaaatttccattgcaattttgtagattttttgttttcttatcttggatcccaaaatcttgttttattggtttacttgaatattttttagtggatttgtaaaaatttcctattacaagatcattatatatgccaatagagatagtttaacttctttctttctaatgtggattccttttatttcattttctttcttatttgttgactgaaatttctactgcaatattgagtggaagtgagaagagtcaatttagtgtgatgttagctgtgtattttttttttttttttttttttgagacggagtctcgctctgtcgcccaggccggactgcggactgcagtggcgcaatctcggcttccgcttcccgggttcacgccattttcctgcctcagcctcccgagtagcagctgtgtatttttttatagatactattgatcagttttaagatgttctcctttacttctagtttaagtgttcttatgatgaagagtattgaatttcattaaataagtttttctgcagttattgaagtgattatgcagttttttcctttattctaatgatatgatatactagttggctttttcagatgttaacataactttgcattcctggaataaaattcatttgtttatggcatttaagcttttcgtatgttcctgaattttctttgctagtgcgaaaggaaagtaaaaatcttgagacattaaactcactatgtcaaagagaaaagttaatcttgggaaacaaaccatgtaaaactggctcccattttgttcctaaacagataaatgcaaaaatagaaggccacatacctctccagagggcctccttcccaatttactcacaaggaaaatcacaaggtcctaaaacagagttctcttgacttttaccctgagagtataaattaacattttatatttgcaggtatataaaagacaggacttgaagccattgtgtggtttttagcataagggcttactgaatggtggttatgttttctcctcttttattttttggaggattaattattttaaatatttgatagaagtatagagctttgatattttctactctaccatttccagttattaccccactatttttttctaaataatatttcactggaagccatcagacactggcttttcttttatgggagactttttccttacagcttcaatcttgttacttgttattagtttgttcaggttttttatttcttcatgggtctatcttggttggttgtatgtgtccaggaatttattaatatcatctaggttttccaatttgttggtatatagttgttcataatattctgtaataatttgtgtttctgtaatctcagttttttgtctcctctttcacttctgattttatttagtgggtctgttctcactttttccaacttagtctagctaacagtttgttgattttgtttacttttacagagtttaccttattgtctgtggctgcttttgtactacagtggaagagttgagtaggaacaagagtctaaagggtttgcaaattccaaaaatatttaccatctgaggctttatagaacctattctgatctctgcaggttcattttttcctttaacctttctatatattcaatatatatttctatatatttctgtattactatatattcaatatattctatatattcaatgcaattttaataaaatagtatagatttttagtgagtcagatgatttatgtttaattatgttaataatgagttaataaattaatttgtatttccattttatttagaataggtgagtttgtttgttatgtggaatggtgcttctgttttaccttttttttgagaaatctctaaactgctttccacagtaattcaactaatttgcaatccaccaacagtatataagcatttccttttctctggatcctcactagcatgtggtattattattaatttatactttttagtaatagccattatgactagtgtgagatggtctcattgtggttttgatttgcatttctatgatgattagtgatgttgagcatttttgtcacgtttgttggttccttgtatgtcttcttttgagaagtacctgttcacatcttttgcccggtttttcacggggttacttgatttttgcttgttgaattattcaagtttcttatagattctagatattagacctttaacagatgtgtagtttgctaatatttcttcagtttacatctcacttgtgaattttgagttttgttgcaattgttattaaggacttagttataaattctttcccaaggctgatgtctagaatggtatttcctagattttcttcaataagtcttatagctttaggtcttatatttaaacatttaattcatcttgggttaatttttgcttggtgaaaagtagagatccagtttcattctttttcttatggctagcaagctatcccaccatcatttattgaatagggagtccttttctccattgcttatttttgttgactcagtgatagatgactataggtctgttgctgtatttctgggctctgtattctgtttcattgatttatgtgtctgtttttgtaacagaaccatgctgttttggtgtctgcagccttataacatagtttgaagttgggtaatgtgatgcctctggctttgttctctttgctgaggcattcttcagctatttggactaatttttggttttatggaaatttttgaatatttttttctaattctgtgaataatgacattggcattttaataggaatagcatttaatgtgtggatggctttggttaggatggttattttaatgatattgattcttccaaccctgagcataaaatgctctaccatttgtttgagtcatctatgatttatttcagcagtgctttgtagttcttgtagaaaacttttgtctccttggttagatgtatttttaagtatattttgtttgtgtgtgtggtataaatgtgattgtgttcttgatttgactcttagcctgaatttttattggtgtatagaaatggtattgatttttgtacatggattttgtatcttgaaacattactgaagtcatttttcagttctagcaggctttaggcagtctttaggattttctaggtatagaatcatatcatcaccaaagaacaataccttcaattcttttcctatttggatgccttttatagctttctcttgcttaggtgctcaattaatacattattgaaatagaaagtgctgtcattttaatcatttatatttgaaatataaaattttaaaaatttatatttgaaattttaatcatttatatttgaaacataaaattttaaaattttaaaattttaaaagatttggactatgttaagtccaaattcattgcagaaatgtacttatccatttaataataataatagttatagcaaattgaattttgctatatacagcaattacatacagcaactcttttagtctcagcaatgctattaagtaggtagtgacattgcttcatctacatttcactgaaggagaatgtgaggcatagacctgataagtaatttgcttaactatacatgattctgtaatggttttgcaaagatgatataggttatctggattcagagtgcaagctcttacccaccatcctatgctgactactctttctgggttacaggtagttacaaaatgtaatatagattcactttttttgtaggtatatattaattttaatattattacaggagtataactcaaatatgtaaaaatatttttctggttgtctatcactgcttaaccaactgctctgaaatgaaggtgcttagaacagcaacattttatcatcatctgttttaattctaggttgttggccaggctcaattaggtgtttatggcacagcatttctcagttggttactgtcctaaggtagcttgggctaatcatctgaaggttaatcactcacatatctggtgattagtattaaaagtctcaagctactgcagtgctgggccaattgtgacttattaggcatacatatgtatttctacaccaaatggtatatttctcctggggactgtggatatagcacagggctccaaagcgagtggagagacagagaaaaaggaaaaaagaatgacagaaacacagagaaaaggacagaaggacagacagagaaaatgtattaacaatttttttgagctttggaagttaagctcctcacttccactatattctcttttttgagacagccacaaaatttgctaaatttcacaggaagggtatatgacttgatgagaggattgccaatgcatttgtaatcacatctcaaaattactgcaaatataaccttaaaaattagaagaaatcactaaactactgtagaattcataaaatgttgacataagacattaaaattttaaaaatttgtttgctaaaattttagccataattaaaaattttaattaacattctaatatatttattaataaatatttaaaatatcaagtaggtgtccaaaaacaggctgtaaatttatcagatagagagcaccggattgctggtcaatttaagttttctaaatggcactaatggattgataatattatattaaaacccaagaacatgctatctcaaatcaatgtttatttcactaattaatttttaaaactatataattaatatataaaaacaaatttgtgaaaggttagtgaatgaagtatatagaatcaaaattaaaagtagaatcctctatgtttatacagatttacagattcttaattttatttcaaagaagaatatcatacttttttttctggaactttttttcatttagcaatgtgatgtggagagcattccatgatattgtctgtaatatgcctgttctctgtaattgctgcataccttctactttttgtggtaggtatgtatgttcattgactgatagccaggcaagtgatggagggaacatcctgtacatacatgcactcaggtgcaagtatatctggatggcagatgactagatgtagaattgcagagtcaaactgtatgtttaattttttttgtaagagttgtttcactttatactctctcacaaactcttttctcagattcttatgtttgatcaatctcctgtgggaaaataattcgttgactttttatggctacatagtaatccatggtgtatacatactgcactttccttattcagtctaccattgatggacatttaggttgatttcatgtctttgctattgtgaatagtgttgcaatcaacatatacatgcatgtgtctttataatagaatgattatattcctttgggtatatacccagcaatggcattgctgggtcaaatggtatttctgtcattaggtcttggaacagacaaccaaatgctgcatgttctcacttacaagtggaagctaaatgatgagaacacatggccacacaggaagctaagtgatgagagcacatggaacacatgaacaacacacactggggcctcttggagggtagaaggtgggaggggggagaggatcaggaaaaataattagtgggtactaggcttaatacctgggtgttgacacatatttacctatgtaacaaacttgcacatgtacccctgagcttaaaataaaagttaaaataaattcattgacttaaggttattgacttactaaattataatgtccaactttctagtacaagtagccatctttttgatgtgattggccatttttacttctgtgaattgtcaattcatatccttcatctattttcatattggtctgtttgtctttttggttggtgatatataatagctctcactatacaagagataccagtcctttatctatgtgttgcaggataagcttgatgtaaattactttaggtttgtatgcatgatttagcaatattatctactatgacactatattcattcaatttttcttaaaaatgtttcatttatctagatacattttataaaaatgttgctgcaatctcttccaataattcccttagcatcaaaattttaatttatttttagaatacattcatgccataggtcatagagtggttattgtgagacttggatgatggtcttcttaccaataaagacacataggtttgtgttaacccatactactttgatcataaagtgtttccttgatgtgtagcttttaagagggccttgagaattcctgagattttattatttgccaatttttggtaatttttgtggtcttttaattgttactgattatgattagttgcaatatgcttacattttaaaaaatcattatcctatttttggtcatgctaaatgacttatgttttcatattagtgttatgggatgaatagagttacaggcttctgaggaaagagagaaacatgagacatccttatataaaatagggttatatagaataattatcatttttaactgtcttctacaaacacattcagtttcacaaacatctgtaaggcagctcaataattctgtgccttgttttggaagaagtgaacacatatatacatgtacatttgtgataatcaaaatcagtaagtccccttaaagtgctggttttatattatcacaacctacaattcagacattttatccaatattaaagtttaaaaatgaccgtgaaagcaaccagttcacactttagaaaagttcatggggaaaagagaattagcttgtgaacaaaggttttcccaaatagttaaattttgtagtatttgtcaggtaggagtcattctatctctaatttgttgttctccaactccaagtctctgagtcccattattttgctcttcaggccctgaatttggcataaagtgtagtagaggcggacagtgtcgtctcctgtgcatcactgttgctttgcgaagaaattctcaatgtggtcagctgctgctgctacagaagtcgattttctttaaacactgccaagaacatctgacttacatagtatattttgatttgatatttattcaaactgagcctgctttttttctttttacaaactctctaaaactgctaaaagtcttcactttataaactatgtaattaccatgatctttatactgttggtaaagcaatggttcactttccccatgtctttcacctcagttcttttctcccctgtgtgaattgtatccattttgttcaaagtgattttactgaataccaggagttatcacctctcaagtgttattggcaatgagattgtttttgccagttatcagtgaattattaaattccaaagtcccttgttgagggtctgctttttagtgccacttgcccaagctgccatagtctatttttctcagaaagcaaagcctgagataagaattagtgtgcaataacttaatttgagaaatgttcttagggtacaggagtaggggacaggaaagggtgaaacaagaagggagaaaagtcagtacaagaatgtgttaccaaactaatcatcaccataactgttgggactaaagctcatgcggacccagtaggaagttgtgtggatgtaaagcgtgatcattaaccatcactttctattgctcacactgccaggttatgcatatgtgagtgagtgctagctgagtttcttcgagggttccatgaagagatgttaaagaagtctggtgcagaaaatgagagacctgtcctatcagaagacgacttcacaaagctccttgacacagcaaaggctagagaaaaaaaaattagctgaaaaaatatggggtgcaacctaatttgatcaaatgtattagagctttcttttttcttttgtttcattttcacagtatattacttttcatatgattaaatactgtaaattttctcaggtttctgataaagttatgcctgtgatacaggagctagaaagaaattatttaggcagatagtgagggtgaaagtccttggtaaggttttgttttaataaaaagcagccccccaaatcatttccttgctaacaaaaagcagccagaaaaatcaagcttcaaacctagataaacaagctaaagcttgcataggtaaatgctggcaactgtgccagtaattcctcaaggatctagaactagaaataccatttgacccagcaatcccattacttggtacacgcccaaaggattctaaatcattctattataaagacacatgcacacgtatgtttattgcagcactattcgcagtagcaaagacttggaaccaacccaaatatccatcaatgttagactggataaagaaaatgtggcacatatacaccatggaatactacacagccataaaaaagataagttcatgtcctttgcagggacatggatgaagctggaaaccatcattttcagcaaactaacacaagaacagaacaccaaacaccacttgttctcactcataagtgggagttgaacagtgagatcacatggacacagggaggggaacatcacacactggggcctgttgaggtgtggtggactaggggagggataggattaggagaaatatctaatggaggtgacgggttgatgggtgcagcaaaccactgtttcacatgtatacccatgtaacaaaactgcagattctgcacatgtaccccagaacttaaagtataattaaaaaaaaaaaagaaagaaaagggatgggataccttgaagccaggtatattcaacatggatattcaacgtggaggtcccctctttccttttctttgtcaaccatatgtgcagtaaagaagcagcaacatggcactggccatgtagagaaaccatttgcttattgaaaattaaggtggggcagacagcttcttcttacactatgtaaatggcacacctggttccaccaatcctttgtgccctatataaatcagacactgtttcctcaagctcatctataaatccctgtgcatttcaccatgggactagaagatccattcgggagcacctttctgcagaaatgagagctattctcctttctctttctttcccctattaaacctccattcttaaactcacttctcgtgtgtccatgttttcagtttccctggagtgagatgatgagttttgagtatttaccccagacaatgatgctgcttaacctgttacttttatttattcttatttttaaaatttttatttattttttatttattttactttaagttctgtgatacatttacagaacgtgcaggtttgtggcataggtattcatgtgccattgtgatttgctgcacccatcgacctatcatctaggttttaagccctgcatgcattaggtatttgtcctaatgctttctgtccccttgtcccagaccccctgacaggccctgatatgtgattttcccctctctgtgtctatgtgttctcattgttcaactcccactaatgagcgagaacatgtagtgtttggttttctgttcctatgttagtttgctgagaatgatggtttctatccatatccctgcaaaggacatgaactcattttttatggctgcatagtattccatggtgtatatgtacacattttatttattcggcctatcattggtaggcatttgggttgtttccaagtctttgctattgtaaatagggctgcaataaacatacatgtgcatgtgtctttatattacaatgatttttaatcctttgggtatatatccagtaatgggattgctgggtcaaatggtatttctgcttctagatccttgagcaattgccaaaatgtcttccacaatggttgaactaatttgcactgccatcaacagtgtaaaagtgttcctatttctccaaatcctctccagcatctgttgtttcttgactttttaatgattgtcattctaattggcatgagaaggtatctcattgtggatttaatttgtatttctctaatgaccagtgatgatgagctttttttcatatgtttgttggccacgtaaatgtattcttttgagaagagtctgtttatagcctttgcccactttttgatggtgttgtttttgtcttatatatttaagttccttgtagattctagatattagacctttgtcagagggatagattgcaaaaaattcctccattctgtaggttgcctgttccctctgatgatagtttattttgctgtgcagaagctctttagtttaattagatctcatttgtcaattttggcttttgctgcaattgcttttggtgttttagtcctgaagtcttcgcctatccctatgtcttggtattgcctaggttttcttctagggttcttatggttttgggttttacatgtaagtctttaatccatcttgagttaatttttgtataaggtgtaagaaaggggatcagtttctgttttctgcatatagctagcaagttttcccagttttcccgttgcttgtttttgtcagttttgtcaaagatcagattgttgtagatgtgtggtgttatttctgaagcctctgttctgttccattggtctatatatctgtcttggtaccagtaccatgctgtttttgttactgtagctttgtagtacagtttgaagtcaggtagagtgatgcctccagccgcttttttttgttttgttttgttttgttttgcttggggttgccttggctatacaagctcttttttccttccatataaaatgtaaagtagtttttctagttgtgagaagaaagtcaatggtagcttgatttgaatagcattgaatctataaattacgttaagcaccgtggccattttcatgatattgattcttcctagctgtgagtatggaatattttttcatttgtttgtgtcctctcttatttccttgggcagtggtttatagttctccttgaagaaatccttcacgtctctttttagccatattcctaggtactttattctctttgtagtgcttgtgaatggaagttcaatcatgatttggctctcagtttgtctattatcagtgtataggaatacttgtgatttttgcccattgattttgtatttggagactttgctgaagttgcttatcagcttatgaaatttttgggctgagatgatggggttttccaaatatagaatcatgtcatttgcaaacagagacaacttgacgtcctctctttctatttccataccctttatttctttctcttgctgattgccctggctagaacttccaatacaatgttgaaaaggagtagtgagagagggcatccttgtcttgtgccggttttgaaagggaatgcttccagcttttttgcattcagtatgatatgggctatggatttgtcataaattgctcttattattttgagatatgttccatcaatacctagtgaattgggagtttttagcatgaaggtgtgttgaatttatcgaaggccttttctgcatctattgagataatcatgtggtatttgtgattggttctttttatgtgatggattatgttcattgagttctgtatgttgagccaggcttgcatcacggggatgaagctgacttgattgtggtggataagatttttgatgtgttgttagattcggtttgccagtattttattgaagatttttggatcaatgtccatcagggatattggcctgaaattttcttttttgttgtgtctctgccaggctttggtatcagcatgatgctggcctcataaaatgagttagggagaattccctctttttctgttgtttggaatagtttcagaaggaatggtaccagctcctctttgtacctctggtagaattcagctgtgaatccatctggtcctggactttttttggttggtaagctattgattattgccacaatttcagatcctgttattggtctattaagagattcaacttcttcctggtttaatcttgggagagtgtatgtgttgaggaattcatccatttcatctagattttctagattatttacatagacatgtttatagtattctctgatggtagtttgtatttctgtgggattggtggtgatatcctctttctcattttttatttcatctatttgattcttctctcttttcttctttattagtcttgttagccgtcgatcaattttgttgatcttttcaaaaaaacagctcctggattcattaattttttgaagggctttttgtgtctctatttcgttcagttctgctctgatcgtagttatttcttgccttctgttagcttttgaatgtgtttgctcttgcttttctagttcttttagttgttatgttagggtgtcaattttagatctttcctgctttctcttgtgggcatttagtgctataaatttccctctacacactgctttgaatgtgtcccagagattcttgtatgttgtgtctttgttctcattggtttcaaagaacatcttgatttctgccttcatttcattatttacccagtagtcattcaggagcaggttgtttagtttacatgtagttgagtggttttgagtgagtttcttaatcctgagttctagtttgattgcactgtggtctgagagactgtttattataatttctgttcttttacatttgctgaggagagctttacttccaagtatgtggtcaattttgtaataggtgtggtgtggtgctgaaaagaatgtatattctgttgatttggggtggagagttctgtagatgtctattacgtccgcttggtgcagagctgagttcaattcctggatatccttgttaactttctgtctcgttgatctgtctaatgttgacagtggtgtgttaacgtctcccattattattgtgtgggagtctaagtctctttgtaggtctctaaggacttgctttgtgaatctgggtgctcttgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggcagatcttcctccatccttttattttgagcctatgtgtgtctctgcatgtgagatgggtttcctgaatacagaacactgatgggtcttgactctttatccaatttgccagtctgtgtcttttaattggagtatttagtccatttacatttaaagttaatattgttatgtgtgaatttgatcctgtcattatgatattagctggttactttgctcattatttgatgcagtttcttcctagtcttgatgggctttacattttggcatgattttggagtggctggtaccagttgttcctttccatgtttagtgcttccttcaggagctcttttagggcaggcctggtgatgacaaaatctctgagcatttgcttgtctgtaaaggattttttttctccttcacttatgaagcttagtttggctggatatgaaattctgggttgaaaattcttttctttaagaatgttgaatattggcccccactctcttctggcttgtagagtttctgctgagagagctgctgttagtctgatgggcttctctttgtgggtaacccgacctttctctctggctgcccttaacatcttttccttcatttcaactttggtgaatctgataattatgtgtcttggaggtgctcttctcgaggagtatctttgtggcattcgctgtatttcctgaatctgaatgttggcctgccttgctaggttggggaagttctcctggataatatcctgcagagtgttttccaacttggttccattctccctgtcactttcaggtacactaatcagacgtagatttggtcttttcacatagtcccatatttcttggaggctttgttcatttccttttatacttttttctctaaacttcccttctcacttcgtttcattcatttgaccttccatcactgataccctttcttccagttgatcacatcggctcctgaggcttctgcattcttcacgtagttctcgagccttggctttcagctccatcagctcctttaagcacttctctgtattggttattctagttacacattcgtctaaatttttttcaaagttttcaacttctttgcctttggtttgaatttcctcttgtagcttggagtagtttgatcgtctgaagccttcttctctcaactcatcaaagtcattctccgtccagctttgttccattgctggtgaggaactgtgttcctttggaggagaagaggtgctctgctttttagagtttccagtttttctgctctgttttccccccatctttgtggttttaactacttttggtctttgatgatggtgatgtacagatgggtttttggtgtggatgtcctttctgtttgttagttttccttctaacagacaggactctctgctgcaggtctgttggaatttgctagaggtccactccagaccctgtttgcctgggtatcagcagtggtggctgcagaacagcagattttcgtgaaccgcgaatgctgctgtctgatcgttcctctggaagttttgtctcagaggagttcccggccttgtgaggtgtcagttctcccctactggggggtgcctcccagttaggctgctcaggggtcaggggtcagggacccacttgaggaggcagtctgcccattctcagatctccagctgcgtgctgggagaaccacttctctcttcaaagctgtcagacagggacatttaagtctgcagaggttactgctgtctctttgtttgtctgtgtcctgcccccagaggtggggccttcagaggcaggtaggccttcttgagctctggtgggctccacccagttcgagcttcctggctgctttgtttacctaagcaagcctgggcaatggcaagtgcccctcccccagccttgttgccatcttgcagtttgatctcagagtgctgtgctagcaatcagtgagactctgtgggtgtaggaccctccaagccaggtgcgggatataatctcctggtgcaccgttttttaagcccattggaaaagtgcagtattcaggtgggagtgacccaattttccaggtgccatctgtcacccctttctttgactaggaaagggaactccctgaccccttgcacttcctcagtgaggcaatgccttgccctgcttcagcttacacacagtgtgctgcacccactgtcctgtgcccactgtctgtcactccttagtgagatgaacccggtacctcagatggaaatgcagaaatcacccgtcttctgtgtcactcacgctgggagctgtagactggagctgttcctatttggtcatcttggctcctcctcctaattcttgaagatttcattggctaaagtaaaacaaaaattctgctcaaaatgaagccaaaatattttgagtatttgcaaaacaatgttgatactatgagtggagttcttaatgttgttgtgttcaaatacaatgtgtgaaacataatgaagctcagtaactttcgtgtgtaacttttggattagaataataaatatcaatataagcccataaggttttatattatttttatttttcttttcttttttttttatggcttggatgacactttattttcagatccaatactagaagttgtttccatgttcacattttccttcctggtttaaaaaaaagagttgtatttttttttttttgctttttttaaattatactttaagttttagggtacatgtgcacaacgtgcaggttagctacatatgtatacatgtgccatgttggcgtgctgcatccagtaactcgtcatttaacattaggtatatctccaaatgctatccttccccccattgtatttttcatagcttaaaaatcattgacatagaataattccagctaaagtacgtattaaatccctggaaaataaattttgtcttaacaaggtaagttgtgaaaagatgttttgtcacaggaaaaaggaaatcctccatttaaaaccctccatgctgaaataaaggaggagtcccatctttcagtcattccacttcaggcttttgatataactaatctcttttcttcttctttccttttttggcaagctttcggaaacaaaacaggcaaaattttgtgatgataaatatcacagttgccacgcaggccagcaggaatgctatcacatccaaagagtggtactggatccaggtgaggttgtgagctgcgactcgaaggtgcttggctcctttgtggcgcatgacaaactcaatccagaagactgctcgatccaggggcttcattggttggtcatgatgaattcttgataatttcatgacattctctttatagctgaaggataaatataaagatatcaacattaaaagtaaatttattgcttaagcatatcaagtctatggatggtctttgaaaagtgtcacacaaatgattgaaagtaagtgtcactgaattggcatgaaatttcaatgttttaattcatgtcattacagaaagtttggtttttaaattggagttttatcactgacaaatacctttaaaaatgaaaaatggaattttcggtgggaaagttaatgttttctggagcagaaaatattatgagccattctaagtgctataagtaagatagtggaaatggaatttgagaatgatctttttgatctttttaatttttttttattttttgagacaggcttttgctccattacacaggctgagtgcagtcacatgatcatggctcagttcagcctttctctttcggtctcaagtaatcctacatctcagtctcatgagaagctaggactacaactgcacaccaccatgcctggctatatttttttattttttacacttttagatatgaggtgttgctgtagtgcccatactggtctggaactcctgtagtcaagtcattctcctgcctctgcctcccaaagtgttggccctacagacatgaaccactgtgcccagcccattttgacgtatttaaagaagaattgtgacacaactggtgaaatgcctcctaactagtttctcagcttctactctaatcttttgtcttctaccatattttccttctagtagccagaatattttccaaattaatatcaaattatgacactcacctgttaagatttccatctggtttcttgttacattaagaataaattccaaatctgtctttggtctagagaactctacacaggcacctacttgtcctagccctttccccctgtacactttcttctagagacaatggccttcggtttttctctaaactcctgaaggtgttctcaccttagcccctttacaccttttgttccccgtgtctctctcattgagcattctttcttgcaactacttgaggtttgcttctatttctttttgaggcttccccttgtatgatacctcttggagagtcttttcctggccacactataggcacccataggatttctctagtgcttcatgcttactttgctatttgatttctggaactttaaaatatgttgtatatcttctacagtaaaacttcaagtatgaaatacataggataaatgtatatatactatgtgactacctcaaaattttaagattatcttaaacattatcccaaagtgaagacaccaatttatcacaaactgcatagaagaactctctcctcctgggccattttagtcactatttttatcctcaaagtaagtattaacctgatttctgatatcatagattagtattgtttatataattgaattaaataatacatattcatttctgtttttggttagcagttgtttaatagcattggtgtagagagtattcagttgattgacaaagaccacagatgatctcttcattttgtgattaatggatatttgtgttgttaacattttttgaccttactaataattatggtattaagatatttgtatattttattaggtttaaatatttattcatttttgttggatgtatacttggaagaatagttgatgagagaaaggcacatttataattagaattttttgttgactgaattttttaaaaaatattttttattttaaagaatcagattgttttcagttatcgtttttggatgatttataatttatttctagtatgactagaacatataatttttatgaatttgaatcttatacaatttacttagtgtttatttatggcccagcatatggtaaattcaggtaactatttcatataatctttttttttttttgagacagagtctctctgtcacccaggcttgagtgcaatggagtgatcttggctgactgcaatttgcatctcctgggttcaagtgattctcatgcctcaatctcccaagtatctgggactacaggtgctcatcccctacatctggctaagttttgtattattagtggacacaggatttcaccatgttggccaggctggtctcttaactcctgacctcatgtgatcctcccactttggcttcccaaagtgtcgggattacaggtgtgagccaccacacccggtctccataaactcttttaaaaatgtttattttctgtctacacacacacaaccagagatatatgtatggatacatatatacagataaatgtgcaatatatatacacacacacatatataacacatagattacatttaattgtgtacttcaaatgttttatctccttaaataaaatatttcaaagatcactattttgtcttttctttttggtctgcttaaatttaatgtgagtactggtaggttcacttttttgtttttttgcttttttgtttttttttgagatggagtctcgctctgtcaccaggagttcagtggcactatctcggctcactgcaacctccgtctcccgggttcaagtgattctcctgcctcaacctcctgagtagctgggactataggtgcacaccaccatgcccagataatttttgtatttttagtagagacagggtttcactatgttggccaggagtatggtctcgatatcttgacctcgtgatctgccctcctcagcctcccaaagtgctgggattacgggcgtgagtcactgcacctggtcagttcaaatttttttaaaaagttttatttttactttaagttccagtatacatgtgcagaatgtgcaggtttgttacatacgtatatacgtgccatggtggtttgcagcaccgatcaacctgtcatctagattttaagcccctcatgtattagctatttgtcctgatactctcactccccttccatcccccggtgtgtgttgttcccctccctgagtccatgtattctcattgttcaactccctcttataagtgagaacatgtggtgtttggttttctgttcctgtgttagttgctgcggataatggctttgcatttcatccgtgtccctgcaacagacatgatctcattcctttttatggtgcatagtattccatagtgtacatgtatcatattttctttatccagtctatcactgatgagcatttgggttggttccatatctttgatattgtagatagcgctgcaatagacatacatgtgcatgtgtctttatagtagaatgatttatatgcctttgggtatatacgaagtaatgagattgctaggtcaaatggtgtttctggttctaggtctttgaggaatcaccacactgttttccatgatggttgaactaacttacattcccgtcaaaaatgtaaaaagctttcctatttctccccagcttcaccaggatctgttgttttttgactttttaatcatcgccattctgactggcatgagattgtatctcattgtggttttgatttgcatttctctaatgatcagtgatattgagcttttttcataagtgtgttggctgcataaatgtctttttttaagaagtgtctgtttatatcttttgcccactttttgatggtgttgttttttttttttttttgtaaatttgtttaactttcttgtagattccggatattagacctttgtcagagggatagattgcaaaaatcttccctcattctgtaggttgcctgttccctctgacgatagtttattttgctgtgcagaagctctttagtttgatttgaccccatttgtcaattttggcttttgttgcaattgcttttggtgtttgtgtcatgaaatttttgcccatgcctatgtcctgaatgatattgcctaggttttctcctagagtttttatggttttgggttttacatttaagtctttaatccatcttgagttaatttttgtataaggtgtaaggcaggggactagtttccgttttctgcgtatggctagccggtttctccagcaccatttatttaatagggaatcctttccccattgcttgtttttgtctggtttgtcaaagatcagatggttgtagatgtgtggtgtttttctgaggcctctgttctgttccactggtctatatgtctgtctttgttccagtactatgctggtttggttactgtaaggtgtaaggaaggaatccagtggcagttttctccatatggctagccagtttttccaaaacatttcttaaataaggaatcctttccccagttgcttgtttttgtcaggtttgttaacaatcagagggttgtagatgtgtagtgttatttctgaggcctatgttctgttccattggtctatatatctgtttggtaccagtaccattctgttttggttatgtagccttgtagtacagtttgaagtcaggtagcatgatgcctccagctttgttctttttgcttaggattgccttggttatatgggctcttttttgtttccatatgaaatttaaagtagtttttttctaattctgtgaggaatgtcaatggtagtttgatgggaatagctttgaatatataaaatactttgggcagcatggccatttttacaatattgattctttttatccatgaggatggaatgtttttccatttgtttgtgtcctgtcttaattccttcagcagtggtttctagtcctccctgaagaggtccttcacatcccttgttaggcatatgcctaggtattttattctctttgttgcaattgtgaatgggaatttattcatgatttggctctctgtcaaatcatgtactgtcagtgtatagtaatgcttgtgatttttgcatattgatttttgtatccagaggctttgctgaagttgcttatcagcttaaggaattttggagctgcgacaaaggggttttctaactatagaattatgtcatctgcaaacagagacaatttaacttcttcccttcctatttgaataccctttatttctttctctagttcacatttaaatccagcatcttattctatatatatatatattttaattttctaacctgttttatgtttctttactttcttactttttttgaagtatcttaaatcatttcttgtcttactaattttttggtaaagtgtttttaatgtattcccttagctggtaccacctaacctcataataatattggtaggagtaatagactctgaattgatggtagctggtctaggcacagcatttttcatagtatttcctttggattatggaaaagttaagtattacatatttattttatcaacattgaaacctttgtatttcaaaaggcatcttccaaaaagtaaaaaaaaaaatctatctgtccatagtggaagaaaatatttgaaaatcacatatttgataagggattgtatctataatatataaataattcttatgaatccataagataaatagaaaaagacaaaatattcacaagattaaaatagaaatttatctaaggaagatgtgtgaatgaccagtaagcacatgaaaagagggttaacatcttcagccataaggaaatgcaaatgaaaaccataatgagagaccactttacacacactagaatggctgtaatagaaagacaggtgataacaagtgttgggaagagtgtgaagaaattagagccctcctatccagctggtggtaatgaaaaatgatgcaaatactttgaaaaacagtttagcagttcttcataaacaacaatttcccatatgtctcagcaagtccactcctagcatctcctcaaaagaagtaaaaacatatttttacacggaaaatatgtataacaatgttcataaatgccaaaattggaaagacctaaaatgtccatgacctgataaatgggtaattttggtataaacatatcaaagaatattatatagaaataaaaatgaatgagttctgatacatcctacaacataaataaaactaaaactaattatgctaagtgaaagaagtcatttatgaaacaccataaattgtatgatttcatttatataaaatatgtgaagagaataatctattgagaaacaaagtaagatggtatttttctaggactagaggtttattgggagtgacttcatacattatgagtttaatttgaattcattaaaatgttctttagggctgtggctttgtaactatgtaaacatactaaatatatttagattttaaattttagtgaatgttatgctatgcaaattataattcattatcacatttcttaaaataatgataataaaaataaatttttgagaaagaatagattcatactttcagaaattttaggtattgaattgaaatatcatatttctctagttatgttctttcttttcattgtgcattctatcattaaaaatatttaaaataattatctacatatctttaatttttttgattttataattcattgcagtcattggtgacccattaaatctgtggggttgaaatgtaactttgaaataaactgtctggtggaaagtaaggacagattttacattggttaaatcacttcaatcccttcaaaattagtctcttaaaaacgggttaaaattcatattcactgttgacaaaataatttataaataccacctggtcacaaaactgtaatactcacacagggtcattaatgactgacttcaatgcattgagcaaatctctacttgacatggtcctgatgtccacactgagggctgctcccttggctttcatgtgagcaatgttatcatgttgatccgcaaacaagggaatgcccaccatagggatcccatggtagatcgcctcatagatgccattggttccaccatgagttataaaagctttggttttgggatgacctaaaagtggatgcattttaacaaaattattaattacaaggtatgagaattgaataagaaatgcacaatataaggaacttaaagcaaaactgttccctaggtaacattatacccacaaaactgcattgaaattgttttcaaatttcagaagaattgccaggtgaacaaaatgaaaaagcatattcttaattaaaaaattaaaatgtgcaaaaaaaagaataagattgggtatacaagaacgtggtcttttaagtattataaataatgaggtcacatttacatatttaaaaaatatttaaatacttaaaatatttaaaatatttaattttttttaaaaggcagcagggagtagggtggaggtggggctgaggaaggaccagttatgcatcatcatgaaatgtgttatcattttatcatgataaagattggttatttattcccataaaaagtagagtcactggtaatagaaaagtgtccgctatttttcagtgcctgttgaaataaccctgcagtaggggaaagaacagaggtaaagctgcataaataggagacagacagaaaatccaggatgttatttaaaacctgtgagaggaaattacacctgaacaaagagatttttattctgaccataaagaatgtgactgtatgtaataaaatgccaactactatagtgcattctttttatactaagactggaaaataaatataaagtagttaaatttgatttgttttttagttttccaataataaatgctaaatatgtttgttttatgttgaactattatcactccaatttgctgttactaatatattcactgtttgttctccagaatcttaccaagaaggtcattctggggtaaccacttgtacagtcgagtattggaacctaaagtatttggcttcttgccatcaaatctccatagaacctgttagggcaaggaaaatatcttgttcaatgaatagaactctaaaaacatagcatgttagaattctgaagagattaataatcagttagttaatccatataaaagatgaagaaataagaagaagtgatgtcaagtaatgagaactactaaaagtttgaggtaagttgaatacccacgtttaatgtcgttacttttataatcaattttgtatataaagaaataatgacatttctaacataatagctagacacatgagattgtgaaaggaaaataaatcttggcaacccaaactctatgctaaagggaaaagttaagctgcttagggcaaacctacctcccattctattcaaagtcagcccttgactcactgagataaatgaatatcaaattgcctcatttcgagaggctaatcagaaactcaaaggaattcagctatttgtctctcatctacctatgacctggaagccccttccatgcttcaagttgctctgcctttgtttctagctgtcccccatttctggaccgaacaaatgttcatcttatatatgttgattgatgtctcatgtatccctaaaatgtataaaaccaaactgtccccccaccaccttggacacatgtcatcaggacctcctgaggctgtgtcatgggtgcacattttcaaccttggcaaaataaactttctaaattatctgagaactgtctcatatattcagggttcatattttggtaaccatgaagagattctgagtggaggttccctgacctttgataaatgtcctatcagtgcttggtaccagcatgagctaaatttatggctcaaacaaagaagacaattggctgaggtctgggagcaacccctccagagaatctctgataccccaaaattcagacaagatctgaagtttattttgctgtacaactcctttttgttttttttggagttttacttgcttcctacaagaaaggcaagatttcctgtttccatgacaatggaaggcaggtaactctatggagtttgagctcgctcccaggagggaggatgaatttgaggtttctttcctgattctaggatggcagagggcagttttggcctgaaacccatccgtaggtaaacagctgaattgcggttttgtcttggttaatgtttaacaactagctggacttaatttctccttaccattacagtgcttagtgatcacatttctgggattttttttttttttgtacattccagtatttctcccatcagatttgatgaactttacctgacttgatcaaatctgagtgagaattccaaattgtgggtaacaaagcctgtctaatttggctaaaattctttgcagacgcaaaagagaaaacaaaacaaaacaaaacaaaacctaaaaaccatgctcttggtttctgtgtttgcttcctgtctttaaaaaaacaaatgttcttttgtttacttttcctccaccctatacctccttttgccttttgccatttgcagtatgaaaaatctagagaaggcttctaatgacttgaactcttttaaagaattcagaacaaaggcaccactcacccctttaggggtgtctgttttctttgtggagttccaagagttgtgggcagatttttttctcagtccaaagctctgttttcctatgttgaatgacctgatctctttggctttgagattaccacagattaccttgtactgtgagaggattttaccttggcatgtgtaatggcagacgagttacaaagtagggggtggctgagtacagtttactggaagtagtattgactgttgctatttttttcctcctaggaagttgttgtttaagaatcctaattctagtttggagatgtgttgtaaagggtctcctctattgtttttattccccaaattaatctcatttggcttgtctgtgtggatttgtgtgagaaactgaactgtggtttacataggaaaatgagagactgagttttctcagctccaaagtgaaagggcatctgctcctcccaggcaaaaggcacccctaagcaactgggggccttgtgggagtgtcttggggttgaccccctgtgacatggagtggccctgcagggaaatccccaagaaaaattaacttttaaaaaaaggctagtccaggaaacacatatgagggcagatcacccagcattttgagccctctcagaggtcatacacctctggagagagaaactgagacatgtaagagggtggaaacaactcagtggtgacacactgtggagtactgcccacaagcagcacacattgattcaccacacataaaccctaggccacagctcagttcctccttttaggaaaaaaagtgggaaacaaataatctaagaatgatgagaaaacaagaagaatgaccccctgatatcacttggtaggttttatgacacctctacttggcagagtttatgtaaaatgaaggtaatacggtctttgtgcacatatacattaagaaccctaggttgtcctgcaagctatagagttcctaagttctctctttttaaaaaaaattcttttcttcttgctttaaatttgcttttatttttctattaagataaaaaccacactatggattcaacaggtttttgtctgcaagctggtcaattttttttatctcatggctaaagttctgaagtaaaagccatagaatcttttgtgtgtgtgtacatgtgtttgcatatatttaaaaggccattataatttctataattttatgtttaataggcaattgaatccattttattttccttccagcacaccaaattttttgtctctgtaccttatgatgtaaattttgctatttaattttcacttggtttcttttaatatgcaaatgtaagactatttagcttacaactgcctatggtgatcaagtattcatacagattacctattgaaacaggttatcaagaatttggaagtctaatatggcaaaatgtagttttcataaatctataagatgtacttctattggcatgcttaatgtgtgtatgtatttatgtgttttgtacacaatgttttattactgaaaatatataaaagagctctaattaattggcttaagaaaataaaagtgcttgaattaaatactttgccagaaaaaaaagactagtcaaatgctttttcaagtttatgtaacttcaataaaatcttttataaataagataactttacaattattgctaaagtatgataatattagaaatgtcttaagaatttccagcatatatttttgtttgcatttattaatcaaacaatttcatacttattgttgccaaatactttaaggtgtcaaaatttgacataagggttacaaaactgtaaaccaagcacaaaacagaatgatctttgcttgtgtaattttttaataaataagacattgatattggtttaatgaaaatagccacatcttgaattaagtaagattatcataacttctaaccctgtggccttaagcaatctagtccacaggcagtaaggtttgttttgggaaaaaactgttatcatttttatttcaaagctaaaccataaagggtgtgaaatggcaacactatccttcaactcattttcaactcatataagtttttttcctcaagttctgtttgttgtggcataatgctaacagtgctttctaaaagctattcagctcctcaaggtccagggactatcacagaagaggtgggtgtgtgagattttaagaactgatactgagagataagttagtttatttacaaattaatcattaatgtcaaagacacactaatgcaagaccaacatatgggcccctgtgtcagattaacaaggttttctggaagcataaactgacttcttaataaagattataaaggttatgaaaggctgaggaaagttatatcttatggtcaagattagaattttatagattgttcataaaattttgaaaaacaaagttatttggcttcatgctattttattagggcttattgtttggcaaattgagtctcctctctcaaagaatgaagatttttgcctttttttgaaatccttgagttaccacattagtcaaatgaatgatttatcttacctgtgatattaagtgttttaaacctttgatatttgagaaattttccaaacaaattataaattatgattttttctgacctaagtaatcctttaatttattagtttccctaacatccaaaaatgacataatttggtttattttgtataaaaattatacaggaaacattgtcaaatatgaaatggtgtttggtctttttgagctgtatttatataagtatgttattgttatgtgttccaaaattatgggaaactcctataattctgatatgacttagtgtgtacgttatcagtaacaattatatgtgttaagttattgtgtgccacagaggtaacaaatttccttgtccattgtgtctttgactgagtctgccctaaaactttttgtcctccacagacaattgttgtcttactttggtcctctttagaaggcgattttatactcagccataaaattctaacaggtgctcttgaaaaaaagtttttgataattttggagattgtgacattagaatggaagaaaaactttcaggactcatggagaactaaaatgttcatgagtatcaagcagaacaggaattaactacatggactgaaataataaaaaactaaagtaatcttttagactttgcttaaaacattgctgatcctttgttttgtttttttttcagagtgaaggaatctttttttttttgagctattaacagcttttaacaatttagtatactcctatgaaaaaaatttagaacatatttgtttccctctacctgatttttcagaatttggaaactatttgtgagtattttttacttttgtcaatacagttatttgcataagtgcaataagaatctattttcatttttaacaaaacacaattggagaaactggttattttatcaaggcttccactggtatggtgggctttcctttagggaatcaaacttaacttatggagccaataaaaccccttgggaaaactggcctcataccttcatctataaggtccctgtacagggttcctgaactgtgttaagcaaagaatgtaactttctgacaggcccaggaaccccaagtttattttggaaccccaagaggagaggaattcacccaactcgtaggtatttgatggtagaaatctatggctttcctcagctttaaaaaagtcctatctgagattctttctataagacaaagttccatcaaagccactttaaaagcctatgtaaataaaaaattattcttcctcctctgtatacaataatcaggccaagtataataaagcaaatcagttgtaccatggtttgtctttagtaaaattgggaaactgaagacagaaaaattatgtttcaaaaataacagtatacctgttgttagattctagtcttgcctaatgtttttcaacttttattactgtctacagtttggactgaattctaatttttcatggctacacgtcttcaaaatagtgtcttcaggttttttttcctccctttccaccatttttcctagtttggagtcactgtaaactaagtcatgctttcataaagccctacaaattaagctagacaacttaaacttcagaagaaaataacagcagccaatttacatacataatccactttcttacctgcctactgatttatggacttcagagtaatgggcctatattaattttcaaggatttttcttttgtttggttttgtttttctccctttctccctttattttgtcttcataggacatgagacttcacaacctactaaaaatgaactttcctaataactcaggacctgcttaggaataaaccttccttgccattagagatcagatgaaaacctgagaccagagactcattttcttctaaaatgctttctccaaaagattttttttaaatgtaaaaggaaaataagcctgggggccccaaagtcactaagcaaatcactgcctcccattctattcaaagtcacccctctgctcactgggataaatgcatatctgattgcctccttggagaggctaatcagaaagtcaaaggaatgcctcctccctgcttcaagttggcaaaaataaactttctaaatgtactgagacctgtatcagatatttggggttcacaagattatcaatgaaatattcaaatatttaagaattgttaggcagtcttaattctagtaataaaaaagtagcaaattagtaataacctatatatttattttatatactttatactagctgtaaccttccaaatttaatataaatttattaatttttgagtgatatgagaagagtttacttatatccacttgtctactagtcataagttattttatgaatttgacatcattgattacaaaagactaaatatttaaactgcacatatggtgagaaataatgctacatatgtagtatgtgtaatttcttttcatttgctaactatcaagtgctactttcaggaaaaatttcaagtggcagtgtttgacacaaattcagactattatcagtattgctacttttgtaaatgctaacaatgtaggaaaaaggagcccattgacaattcatgattaacaatacagatgctgaaaatgtagaaaattgtattttgctgcattttgcttaactgatctttcacacttagatgatgcactacctagcattgacagccttgatatatggtcagctatagccagtcattaccatgtctagtaccaaactaaggtactgattttagaattcccaagcaatctttataaactggagtagaatttacaagtgttgaccttgtatttgatatgggagtgttaaagtaactctgtgttttcagcaaaaacttgcatagatcattcagagagggctatgtcagataagaaactaaaacgtaaattgaaaatacacaaagattgtatagattagaaaataagttcctaccatgtttatttatattttctgctccttcctcaatctggagaaggcactaatctgattcttagagcatagtctttgttgggccacatttaataatgcacatagtctaccctaaaagcaggattctatctccatcctttccattacatttttctgcttaagacattagtggcacccaagtcagcagagcagacaagttttttttttttttctctaaatctacttggctaggtgggtacctccagagcagtggctagtcagactaggacattctttctctgaatggcaccctgaacagaacgctaaatagacctattccaatgcatgggaagtaaaaacagccagattgcttggtaagacgaagctgcatgatgcatttcaaagttttttcaatacctgcttattgttattgtgatagtacagtaacttattaaaatttaactgctttttgataatatctacagtgtatacagtaccttctaaaatcctgtaaaccaaaaggagcaaatgacagggcagaatttagtgatttctatgtacatgctacgataccatgataataccaaacttcactagcacctcttaaatatatttccttctgatcacaatattaatgccaacgttattatcaaccaaaactcctctctttatgattttaagatcttccatatatgtttttgctttgaacagatgtctgagataattagaactatcatagcagttaaattttcaggcagaacatttctgtaatggactcttgaagagtttaacagattcatttagtagccatccacagttaaggcactttatctaaccttttgtgggatctgggcaagggctgatgcaatcatgttggcactttcttctgacatgttactgatcatcgaccccagagaaaacaccacaataccattttctccagagctctgcacaaactcttccatttcctgtgaagaaagaatttgttctatcagaaaagagcaacagcacagaaaacactattgacaggattgttacaaacatctaagatgagaaagtcaggagctattggagtaatttttttaaactgacctaatcattcagtttctttgaaaggagatgtgtaatataatatatgtgggatctttcatgcaaatttgtgtaaatatgtgtgcatatgcatgtatgtatgtgtgtgtaaggaggaaatgaaacaaagctatgacactgcagtaggaggagataatgctagaaaatgttacacccagacactttatttataatattataattactaacataggttattggaaggtagctttacttggcttcaattctaattttttttgtggttctactaaatctcttgtgtttatttggagtagttttattttattttatttttttctgttcagttcttttagttaggagtcattggagccattacatgactatgagcaatgaggaaaagttagttacaattggaatgatattatatctacatttatttagcttctagctctctaaccctttatatttcacttaaagttagggtttcctagtcttaccccactacccctcactgcccccgacacccccaccccccaaaaacaccttaaaagctgaagtataagaatcactgacattcagcagtctggtattgtggtttggaatttctgggaaatagttctgagaattccatttataatacagtattatatactatatagttacataattaagtgatcttatttctcaggtcattgcttaggtatgactatgacaccttttgtcctgaaatcacactgtgaatttgatgtgctatgtataactgaatgtgggggaccctcatcatcactttgctgtgtctcacagggggcacttgaaccacagtgggagaggtcaccaggactttctccagtggagatctgctcaccccctagagtagctccctcacactatatgaagctcctggtgaatatgtgtttgctttgaaatgaatgagaattattctgacttgtgtttcctgatgtgtccctgtttttaaacttaaatccattctctaatgccacatcgctcaatgtattctcacaccaaaaaaaaaaaaaagagagagagaaagaggaaaagaaatgtagacccataagtttcctggatatcatatcaaaattgtatactcatctttttgttgctgttgtcccttttgttctaaattctctttttctcagtaaaataatgaccaaccccttctgtcataacaaatatactttctggtcctaatcattgggggaaatttctttataaaactgtttacaaataaaaaaagaaattctaaaatatgtcaattcagaccatatattggtaagtatttttaaaaaatataatttaactttatgacatcttttttttttttccagatggagtctttctctgtcacccaggctggagtgcaatgatgcaatcttggctcattgcaacctctgcctcccaggttcaagcaattctcctgcctcagtctcctgagtagctgggattacaggcacctgccaccacgcctggctaatttttctgtttttagtagagacaggtttcaccatcttggccagagtggtcttgacctcctgaccttgtgatccacccgcctcagcctcccgatgtgctgggattacaggcatgagccactgtgcctggcctgacatcagttttaattggagattcagtgtatggctattagagataattcatgaggcatccaggaactcagtgtaattgcagttgcctgtagccacatttaatgtaacttgagttcaatgttttgtctcattcactgccaaaagtctgcttcacccacccagtattgaagtaataaaacatctatttatagacagatcagcactgatctcattctgtgatgtctttatgaaagtaatggtaatagaagatcaatgtaagtagttttataaaagtatgaaaatttagaaaaagaaaatcatttacccatatctctatctcaatttaaaatgtgtaccatttcattatgggtttaattctatttatataactcaatgtacatatgtgatgtttatttagaaaattttattctcattgtatatgcctttttattctacaaaaaaactgtgatcttgttctactcatcattttgttccttagtttccaactatacctgtaccacggctgacagtgtaattaaacattgttttgaaaaaaggattgtaatggcttggtatgcacattatgtaagtttttaaccatttcttaatgtaagatatttgaattatttccagagtttttttaatgagtatttgctaccgatattgaatcttaccatcatgatttattctctgtacagtttcatgtgagtatattataaaggcaatgcctatatgcatttttcaaacacttgatactttttggcaagagtcttattcttttgaaatatacaaacattatctgagaatctaatacataatggaaaagcaagcaaatttgtggcaacaattattttgtgtacaaaagaattagagaatcagtttcacaattatttacttggattcaagtctaccttctgcaagttaacaacaacggaggctcacacttgtaatcccagcactttgggaggctgaggcatgtggatcacctgaggtcaggagttcaagaccagcctggccaacatggtgaaactctgtctctactaaaaacacaaagattagtcagatgtgttggcaggtgcctgtaatcccagctactcgggaggctgaggcaggagaatcagatcgcttgaacctggggggtggaggtttcagtgagccgagatcatgctagtatcagtaataatcactattgtactactagtcatttatcccttgtccttattctgctactctcttccccctgctactggcactatcactttcttttaatgtgagtgaggaatttttttttgagaataagataagagtacacagaattaccttttaagctagaatattaatgaagagcctccacctttacaatacaactttagctttccagcttgttcaactgactgcccaaacttaaacatttacatttaaacaagtacacagagtatctgttctctaggactttgctagagaatataatcttgatgtgttggaaaatcaatcactattaaatgaagactgatatcttaaatggctggcacatgttagctaatttaaagtattaaaaataatgactaaaataatcataatatcaacaatatttttggatcactggctgtgtgtcagagacaacttaagtgttttatctgtggtaactactttttttccacacagcacaatatgaagttgtgattattattataaaagtagtcatgattgcttaaactcatgtaaaagttcctaaatgatctttacattttacaaacttgcctttttgcaatattatacattgggaatattgggattttttaaaaggaaatctgatcatatctcttcatttcttaactcttttcactcttttcagtagctctccattgtccctatgggtatatcaaattacatatatatatatatatattttttttttttttgagacagattctcactctgttgcccaggctggagtgcaatagcgtgatctcggctctctgcaacctctgcctccggggttcaagtgattctcctgcctcagcttcccaagtagctgctattacagtcacctgccaacatgcctggctaacttttgcatttttagtagagacggggtttcaccatgctggccactctggtctccaactcctgacctcaggtgatccacctgccttggcctcccaaagtgctgggattacaggtgtaagccaccacgcccggcccatcattgacttttactcaaccttttcctgtaaattaaatttggagttcctgggaactgcccttattgcttttctacttttctgccttaatgcaagcctttactttttttttttttgtttatttgtttgtttttgagacagagtctcgctctgtcgcacaggctagagttcagtggtgtggtctcagctcactgcagcctctgctcccagactcaagcaagcctcctgcctcagcctcttaagtagctacgactatgagactacaggcacacaccagcatgcctggctattattttattttttatttttgttagagatgaggttttaccacgtttcccaggctggtctcaaactcctgagcccaagcaatcatgccttctctgcctcccaaagtgcagggattataggtgtgagccaccttgcctggcctctggttttctttttgggtgtttctcatcccctcatcgtttcacctatctctgcacattattgagtactcactttaattgtcaatgagtttgggatctcttctgcatatttctttatcattgtggtctttccttataacactttttagacttttctttttcattgtttttattctatctttcaaagtacaatgtaaggcatgagggagcagaaactgtgctacctttattctctgaaaatccagcacttacctgtggtttgtattaatcactctacaaatattttttgaagaaatgaatcatactatcttttgggtggcacaatgaaggccttactttaaccaaccctgttttcaaaatctccctagtaaacctctttggtctttaatgataataacattcacatacttgtgatactacagaaatatatgattttctaatggcaagtccttgtttttgacctcccatattcccctcactctgagttaaacactctgaaagaaacatatccagccattccttctgaaaatgtcaagcaaacaaatgaaacaagaacacatttaccttaggcaggggtttggctggtttacagtgaagtcctccaacaaaatcaacatttggtaagaatgggcgaggaaattcaaaatcccaataggttcgaatgagccacatttcagctttccccattgtctcaaataatgtagtgggtcttcctgatggaaaaaaacaaaacaaaacaaaaggtagctaacacgagaattgttatttgaatatgcaggtattttcctgaaaggacttggaataacatacccaaacatatataaaatgtctgtgcattgataaaatatatataaatacatttatatatagtcataatttagattttatttattgcatatgttgctcatatgtatatataaggaaggcaatgtattcagagatctgtaagaagaaatcacatctttaatgtaacatcagtatattcacaatcataaataattattaaaataagtcactaatatggtttgactgtccccacccaaatctcctctcatcttgaattataatccccataatccccatgtgtccagggagggacccagtggcaggtgattggatcatggtgtggattcctccatgctgttctcatgatattgagtgagctctcatgagatctgatagttttataagtgtctggtatttcccctgcttgcacttctctctcctgccactaagtgagaagatccaagcttgcttccccttagcctttcaccatgattctaagtttcttgaggcatcccagtcatgtagaactgagtctattaaacttcttttctttataaattacccagtctcaggtatttctttacagcagtgtgagaatggactaatgtagccactatgaacttaaatacacatttgtcttccctctgaagctgcaatagtaacaaatatacctttaaacaactctttcagttccacaattaattcatcttaccttacccatgaaaacagctttccaggaagtactctagtgtctacagtttattaagctagtcccttgatccttggttctcaaagtaaaccatgagttttttgagctcaacactgaaatctttacacctactactgtcttggttcatcttaagatcttaatataattagatttttaaaataaatatatttacaaatgagaattaaaacattttcagaatttattgacatagagatatgtgctctcccttaatttggcccctattttctttgatggagagatgcagtttaataaaatatagattaaaacttagatgttcactttcaacaagatttcagtttttgaaagaaataattgtcaacctgttattgaaggaatgtataaacattagaaatctcaagttttaggcttctgtttctggagtagagccactatattactcaactgtgaaggaatccttcttacatgaaaaacaaaatttaatttctaaatgaggaaactgaggaactcaaagagaaacaaattcctcaatcctgcattgataatttttctagaaatatgtgtaaatactaaatttacgtgtctgccttcatgaagatgtttcttgaggtatctattgactttttttaaagatgaaaaaatgtatagcaaaatgatatgtgatagtttaaagaaatcattagtgctttacaatgaaggtttatgactctctgggtgtcctgtagtagtgatggccccagggttctaactgattctataaggtcaacattctataatatttttgagactgatagatcatcttacatttgcaattcataatttcccttaaaaacactatcttctgacattatatttatataagctcaccttcaaaggcacagaaaagttagaacttaataagcaccagttagacacatgacttacctagaacttcactataaaactggtcccacttcttcagatcataaatttgaaaccaaaagtcaaaataaagcatatgtatcatattttttatcctctccatgaaaatcatttgatcacttaattctgacataacaacaggtacataggaaggagggaacagaaatcctccaccattcttctcaaatgtgtagccaacagagaatcgaagactgtacagaaagggtatgttaaatagttcagccagtagctcaccacagggattaagggcatctgccagaatgacatcaaactttgactcttgtagtttcatcataagtttcttattcaaaactgcatctttacagagcttgttactgtagtcataatattcccaacacaattcttgtaattgtgaaaaatatgaccaaaatgtattttttgaaacaccatatatccatctatcgagaattttcagaagagaatcttccaaatcatttttagttaaagatgtaggataaacttctaatttaatagcagatgatttactggcattgacaagagtagaagccgaagatgtcaacacagtcacctcatgacccctctgaacaagctcttccaggattgtcttcatatttatccaatggctgtattctgtgggccacactagcacctttccacagcttccagagctaaagtaacaactgagctgtatcagcagaaagactgacgtccatttcagagacatcctggtcttatgcaatgcttcttttccagttgttgtttctttctgtcatttctcatacttatatctgaggaaaaatcaatcaagttaaaatataactgctaaaatttgaagtaaatacataatactaacagtctgaataggtgcatgccaaggagaccaacaaaagattgatgacctcatatttattttagtgtgtttggtgttcttttatgtttacaattactctagtcaagcaataatttttatgacctagaatatgtaagtaacctgtcttatgtaattattttataatactgttaagaacagtggcaagtgagaggctcctgcctgttcggtgcccttgacatagagagaagaagtaattatacaactcaaacggcattttttaatatcgtggtgcaagtaatgtcttctaaaactttgttgacacataattcatatgccatatgactcaccaattagtgtgtacagttcaatgtttcctagtatattcacagaattttactttcactacaataatcagtattatctccaaaagattctatacaatagcctctaaccccccactctgaaattttgcatccatcctaccctaggcaaccactaatctaatttctatctctatagattagcattttctggaccctttaaaaaataaatgagggttttccagtgatcatggcagatgggatgcaggactagattgcagctccagacagagcagcatgcagaggcttgcattgtgaattttagctgcagatcaactgcaagaacagaccagcaattctgagaggatccacacaccctctgcaggaagcgtactgctcctgcaggacctgggagacatcccaaacactgtgagtgccccaacaatggaagtgggaaagggtgatccccctctccagaatacacatccccactggagaagctgaagttctgttggcaggagaagttcctgactttatgtgaagctgagtcaaattagagaaccaagccaagcaaaatacaggggtagaggaagtagcagaaaggcactgggagctctctggatacccaagcggctcattcctgcctggcatcacagggatctatcaggagggtggccagtgatgcagggggttcaaagattctcctcagggcctgaaggcttgaagggatgagtaactcctcccttctcaggcccagccccaagatgcaagaccacttgcatcagcagcgtgtgtcagcaagatagcagaagcaggaagagagccggccagaagacacttaccctggctggaagagatgtacccctgaagatcaagaaataggccatccaggtactacatagcagtcacaacagactgggacacttactgtttacagaggactacaaaacccctgtcccatcctcactgggggctgatgccattttaggcctcagcccacctgcaaccaggcgttcattaaaacagcatgttgctccacaccgcctcctgttgtctgttggcgcgctgttggggttcaaactgattcaagaaccttacatctggtgccaaatcctaggaggggctcaggtctgtgtcgcttgtggacctacccctccaccccagagagcaggccacagcaattagacagaggaagctcctcagcctccagtcgcctctctgtgcatgcgcatcagccactgatctcgcctactggtaagtttcccttggagcccggttaacagggcaaaatctacatggcctctcttggtttctccagtccaaaaatccaacactgatccaagaaggcgccagcgtgcgccaggcactcgctggtcatctggtcttagggggatgcctctaagccatttcatcccattccaggaaccaaaaaggcagcggagacgataactccttttatcgtctccctccagctgtccaggatggtctcctttttccctgttctctcgagctacccttcattatgggaaactcccggtcctcaattccaaaaaacagccctccagcctgcctcattaaaaatctgcaaaccttaggcctcaggcaagatatctgccataagtgccttgtcttttttatacgataaagcctggtcgcagtatgaattagataacgggtccaaatggcccgcaaatggaacactcagctttacagttttaactgacttaagcagttattgcagatgactgggaaaatggggagaaattccttgtgtccaggcctttttgcactcagatcacagcccgacctctgcaattcttgcttacctgttcaaatccttcttcattctcgccgccctcattgcctttatcctcccgaccctacctctttttcctcattggatggagcagactgctgtccacccctcccagaccctacccctccatctcaaccaacttcattaactccccaagcttcctcattgtcttctcagccaccatcttcccagccaccatcttcccagccagcatcacccacttcttttcctataccatcctctcctcaggaaaactctagcattgcctgtactcattctccttccttacagccctctcacggagcctgtaaacccatcccgccaccttacacccgtatctatcctccaatgcctatcaactcaaccccccttccctcttcaaaccctcagcaggaaccccttctggcttcttccttctctcctgcccatactagctccggcaccatctttggcccccatgccccacccgtactttagcgccagtgctagaatgcccccttcgggaagtagcaggaactgaaggtattgttagagttcatgttcccttctccctcactgatctctctcaaactaacaaaagactcagttcatttccagaagatcctacctcttatattagggagattcagtaccttactcagtcttatgaactaacctggcatgacagctacttatcttctcttccaccctcaccccagaagaccagcaccgtacttggaccctagctcaggtgcatgctaatacaattcatcatcaagctcctgcccagcctactggcacagaggcagttcccaaccaggacccccactgggattatcaagacagggcctctggacacagccatcaagacctcatgattatgtgtctccttgcaggactcaaaaagggtgcccataaagtggtaaactatgaaaaactttcagaaatcaccgaaggtcctgacaaaaacccagccctttttctctcttgtttaactgaagccatgagaaaattaccaacctggacccagccagcccagaaggaaccactatttcaaaccttcagttcctcacccaatctaccatgatatttggcgcaagcttcagaaggttgatgacggccctcaaaccccacagtgggaccttcttaatttagccttcaaagtctttaacagttgtgatgaggaaagtaaaagaaaaaaacagtttccaatgcttgcctttaccctgcaggcccacagggccacagctccatacagaagcctcctagcaaaacacctccacctggcgcctgtttcaagtgtggcaatgaaggctactggtccaggccatgcccaaacccagctgtgctcaccaggctgtgccccctctgtggaggactcagtgaaagtcaggctgtgagcggctccagcaaggatcgcctccatccctttccgagctggccaaaacctcctactcggatctcatcggccttgccactgaagactgacagtgccctggaacagatgtcccagcaactaccattgcttcatctgagccaagggtaactctgatggtggcaggtaggcatgcatgttttttaaaaattaatattggagcaacctactctgctttacctaaattttcaggacccacccagtcctcccaagtctctgttgtgggaatcaatggacaagtctccaaaccccaagacccccctccacttttctgctccctgaacaccttttccttcagtcactctttcttagtcctgccttcatgcccagctccgctcctaggcagagatattctttcaaaactccacactactctccacttccacattccccatagtacccaacacatcaacccagacccctccaaggcttctaacaggcttctaaccttcttctactcctccgacctcccaccctgaaacatgcaacttttccttatcccgcacctgtagttaaccccactgtttgggatacttccacaccctcggtcacagagcaccacacccccatccacatcacccttaaagagcccaccccgttcctatcacagaagcagtatctcatcccccaagcagctctcataggcctaaagcctatcatttctctcctcctcaccagtcacctactctgcccaacaaactctccttttaacacatcagttctacctgttaaaaagccagatggaacttatcacttagtccaggacctcaggctcattaaccaagctgtactcccagtgtgtccagtagtttctaacccatatactttactttcctcacttccctcgaataccacccatttttctgttctaaacctaaatgatgctttttcacaattcctttacaccctgattcccaaaacctctttgcctttacctgggaaaaccccgacacccacctttcaggtcagctcacctggtgcgtactacctcaaggttttagagacagcccccacctttttggacaggcccttgctagtaacttctgtactttatccctaaaatcatcctctcttctttaatatgttaataatctgctcctgtgtagcccgtctcaaagagactgcaacacccatacatactatctcccttttaaacctcttggcagaacaggggtatcaggtctcccctaagaaagcccaaatatgcaccccccagtcacctatctaggcctagctcttacccctgaatgcaagggctcacaacagaccacatactccctccttctgtccctcccgcctccacaaactaagcaagaaattctctcttttccaggattagcaggatattttaagctctgggtttcctccttcgctctacttaccaaaccgttgtaccaagctgctaaaggccctctccatgagcctttaaaacctgcacagcctattacccaacctttccatctactccaaaagtctctcatctcagcccccatcctcactctcccagacttcaccaaacctttctccctctataccgatgaatggcgtggagttgcactaggtgttctaacccagtctaagggacccacccggccaggttgttgcctacctccctaaacagcttgaagccacagttctcggatggcctgcctgcccctgagcattggtggcagttgctgtcctcactcttaaaagcctaaaactatctcttcatgccaacctaacagtttattcaacccataacatcaaagacatgttagctcaccgcagtgtactaagtcttttctctgccccacggctcctccagctgtatgctctattcatagaaactccccacatcaccatgctaaccacctcccatctaaacccggccatgctcttacccgaagctacaaccgcccaagactcttcttcacactcttatgtgtgaatactgttcaaacctttcttataccttttccaaacctaacagaaaaatcccttccagatgcgtcctttactcggtttgtagatggcagctccttcctacatcaaggacaccgacatgctggctatgctatagtgtcaccccccaacactattgaagtcaatctgctcctcttaggcaccacctcccaaaaggctgaactcattgccctcactcgagctctcattctagcatccggaaaacagatcaatatattcaaattctccttatgtgttccacgtagtgcactcacactcatccatctggaaagaacggggtttcctcactgcaaacaatactgtcataagtggctctctcatcagcaagctccttcaagctgccaggctcccacagaaagttgccatcattcattgcaggggccaccaaaccccagacaatcctaaattggctggaaatgtgctagcagatcaggtagccaaacaagtagccctactaccctttcgaggccagttgctgtccttgtccttgttctctcctctttacttctaagaagaaaaagatttccaagcccaaaaccttcaaaagcaaggacgatattatgtcaaggaagggtgcttagttattcctcactctcaaagccttcctcacctccaaagcctccacaactctttccatgttggttaacaacctcttgcagcttctccacgctattctcacttgtcgtcacttttccagccatgttcaagaaattatccagtcctgctctatctgccactcaatgtaaccccagggatccctccagcctctgccttttcatacccaccaagcccagggccaggtacctggggaagattggcaagtagacttcactcatatgctgcatgataaatgtctctgctatcttctaatccttgtctgtactttctctggctagggagaagtgttcccaacaacttcaaaaggtgcaaatatcatcacacaaactcatcatgcatacagttccctgtttcagactcccaacatccatccagtccgataacagtcctgccttcatcagccacattacccgaggcatctctacatccttaagaataagtaagttctccacacaccctacacacctcaatcttcaggcaaagttgaaaaaattaactctgtccttaaagcctaactcatcaagccggctctagaaacctgcgagtcatggacaaaaaaatctcccttttgccctcatgagactttgcacaacaccaaaagcaccctctttttttgtttttgtttttgtttttgttttgttttgttttgtttttattatactttaagttttagggtacatgtgcacaacgtgcaggttagttacatatgcatacatgtgccatgttggtgtgctgcacccattaactcgtcatttaacattaggtatatctcctaatgctattcctcccccctccccccaccccataacagtccccagtgtgtgatgttctccttcctgtgtccatgtgttctcattgttcaattcccacctatgagtgagaacatgtggtgtttggttttttgtccttgtaatactttgctgagaatgatggtttccagcttcatccatgtccctacaaaggacatgaactcatcattttttatggctgcatagtattccatggtgtatatgtgccacattttcttaatccagtctatcattgttggatatttgggttggttccaagtctttgctattgtgaatagtgcagcaataaacatacgtgtgcatgtgtctttatagcagcatgatttatagtcctttgggtatatacccagtaatgggatggctgggtcaagtggtatttctagttctagatccctgaggaatcgccacactgacttccacaatggttgaactagtttacagtcccaccaacagtgtaaaagtgttcctatttctccacatcctccctggcacctgttgtttcctgacttttaatgattgccattctaactggtgtgagatggtatctcattgtggttttgatttgcaattctctgatggccagtgatgatgagcattttttcatgtgtctgttggctgcataaatgtcttcttttgagaagtgtctgttcatatcctttgcccagtttttgatgcggttgtttgtttttttcttgtaaatttgtttgagttcattgtagattctggatattagccctttgtcagatgagtagattgcaaaaatgttctcccattctgtaggttgcctgttcactctgatggtagtttctgttgctgttcagaagctctttagtttaataagatcccatttgccaattttggcttttgttgccgttgcttttggtgttttagacgtgaagtccttgcccatgcctaatgtcctcaaagtattgcctaggttttcttctagggtttctatggttttaggtcaaacatgtaagtctttaatccatcttgaattaatttttgtataaggtgtaaggaagggatccattttcagctttctacatatggctagccagttttcccagcaccatttattaattagggaatcgtttccccatttgtggtttttgttaagtatgtcaaagttcagatggttgtagatatgtggcattatttctgagggctctgttctgttcccttggtctatatctctgttttggtaccagtaccatgctgttttggttactgtagccttgtagtatagtttgaagtcaagtagtgtgatgcctccagctttgttcttttggcttaggattgacttggcaatgtgggctcttttttggttctatatgaactttaaagtagttttttccaattctgtgaagaaagtcattggtagcttgatggggatggcattgaatctataaattaccttgggcagtatggccattttcatgatattgattcttccttcccatgtgcatggaatgttcttctatttgtttgtatcctcttttatttcattgagcagtggtttgttgttctccttgaaaaggtccttcacatcccttgtaatttggattcctagatattttattctctttgaagcaattgtgaatgggagttcattcatgatttggctctatttttgtctgttattggtgtataagaatgcttgtgatttttacacattgattttgtatcctcagactttggtgaagttgcctatcagcttaaggagattttgggctgagatgatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctttcttgtgccaattttcaaagggaattcttccagtttttgcccattcagtatgatattggctctgggttgctcatagatagctcttagtattttgagatacatcccatcaatacctaattcattgagagtttttagcaagaagcgtcgttgaattttgtcaaaggccttttctgcatctattgagataatcatgtggtttttgtcgttggttctgtttacatgctggattaagtttattgatttgcatatgtagaaccagctttgcatcccagggatgaagcccacttgatcatggtggataagctttttgatgtgctgctggattcagtttgccagtattttactgaggatttttccattgatgttcatcagggatattggtctaaattctctttttttttgctgtatctctgcgaggcttcagtattgggatgatgctggcctcataaaatgagctagggaggatttcctctttttctattgattggaatagtttcagaaagaacggtaccagctcctccttgtgcctctggtagaattcggctgtgaatccatctggtcctggactttttttggttggtaagctattaattattgcctcaatttcagagcctgttatcagtctattcagagattcaacttcttcctggtttagtcttgtgagggtgtatgtgttgaggaatttatccatttcttccagattttctagtttatttgcatagaggtgtttacagtattatgtgatggtagtttgtatttctctgggattggtggtgatatccccttaatcattttttattgcatctatttgattcttctctcttttcttctttattagtcttgctaacgatgtattaattttgttgatcctttcaaaaaaccagttcctggatttattgattttttgaaaggtttttgtgtctctatttccttcagttctactctgatcttagttatttcttgctgtctgctagcttttgaatgtgtttgctcttgcttctctagctcttttaattgtaatgttagggtgtcaattttagatctttcctgcttcctcttgtggggatgtagtgctataaatttccctcgacacactgctttgaatgtgtcccagagattctggtatgttgtgtctttgttctcgttggtttcaaagaacatctttatttctgccttcatttcgttatgtacccagtagtcattcaggagcaggttgttcagtttacatgtagttgagtggttttgagtgagtttcttaatcctgagttctagtttgattgcactgtggtctgagagacagtttgttataatttctgttcttttacatttgctgaggagagctttacttccaactatgtagtcaattttggaataggtgtggtgtggcgctgaaaagaatgtatattctgttgatttggggtggagagttctgtaaatgtctatcaggtcaccttggtgcagagctgagttcagttcctggatatccttgttaactttctgccttattgatctgtctaatgttgacagtcaggtgttaaagtctcctattattattgtgtgggagtctaagtctctttgtaggtctctaaggacttgctttatgaatctgggtgcccttgtattgggtgcatatatatttaggatagttagctcttcttgttgaattgatccctttaccattatgtaatggccttctttgtctcttttgatctttgttgttttaaagtctgttttatcagacactaggattccaacccctgcctttttttgttttccatttgctcggtagatcttcctccatccctttattttgagcctatgtgtgtctctgcacgtcagatgggtttcctgaaaacagcacactgatgggtcttgactctttatccaatttgccagtctgtggagtatttagcccatttacatttatttttaaatgtattggagtatttagcccatttacatttaaggttaatattgttatgtgtgaatttgatcctgtcattatgatgttagctggttattttgctcattagttgatgcagtttcttcctagccatgacggtctttacaatttggcatcttttgcagtggctgctactagttgttcctttccatgtttagtgcttccttcaggagctcttttagggcaggcctggtggtgacaaaatctctcagtatttgcttgtctgtaaaggattttatttctccttcacttatgaagcttagtttggcgggatatgaaattctggattgaaaattcttttctttaagaatgttgaatactggcccccactctcttctggcttgtagagtttctgtggagagatctgctgttagtctgatgggcttccctttgtgggtaacccgacctttctctctggctgcccttaacattttttccttcatttcaactttggtgaatctgacaattatgtgtcttggagttgctcttttcgatgagtatctttgtgttgttctctgtatttcccgaatttgaatattggcctgcattgctagattggggaagttctcctggataatatcctgcagagtgttttccaagttacttccattctccccgtcactttcaggttcaccaatcagatgtagatttggtcttttcacagagtcccatatttcttggaggctttgttcatttctttttattattttttctctaaacttctcttctcatttcatttcattcatttgatcttccatcactgataccctttcttccagttgattgaattggctactgatgcttgtgtattcatcaagtagtctcatcctgtggttttcagctccatcaagtcctttaaggacttctctgcactggttgctctagttagccatttgtctaattttttttcaaggtttttaacttctttgccatgggtttgaatttcctcctttagcttggagtagtttgatcatctgaagccttcttctctcaactcatcaaagtcattctccatccagctttgttccatttctggtgaggagctgcattcctttggaggaggagaggtgctctgatttttagaatttccagtttttctactctttttttttccctatctttgtggttttatctacctttggtctttgatgatggtgatgtacagatggggttttggtgtggatgtcctttctgtttgttggttttccttctaacagttaggaccctcagctgcaggtatgttggagtttgctggaggtccgctccagaccctgtttgccttggtatcagcagtggatgctgcagaacagcggatattggtgaacagcaaatgttgctgtctgattgttcctctggaagttttgtctcagaggagtacccggccatgtgaggtgtcagtctgcccctacaggagagtgcctcccatttaggctactcagttgtcagagacccactggaggaggcagtctgtcctttctcagatctgcagctgcatgctgggagaaccaatactctcttcaaggccatcagacagggacacttaagtttgcagaggtttctgcttccttttatttggctatgctttgttcccagaggtggagtctacagaagcaagcaggcatccttgagctgcagttggctccacccagttcgagcttcccagctgctttgtttacctactcaagcctcagcaatgtcgggcacccctcccccagcctcgctgccaccttgcagtttgatctcagactgctgtgctaggtatgagtggggctctgtgggcataggaccctctgagccaggcatgggatataatctcctggtgtgccgttcactaagactgttggaaaagcgcagtattatataaagagtgacctgattttccaggtgccatctgtcaccgctttctttgattagaaaagggaattccctgaccccttgcacttcctgggtgaggcaatgcctcaccctgctttggctcatgctcggtgcactgtacccactgtcctgcacccactgtctgacactccccagtgagatgaacctggtacctcagttggaaatgcagaaatcacccatcttctgtatcactcatgctgagagctgtagactggagctgttcctatttggcctagctaattattaatatttcttttcttatagtaattttggttttggtttgttcttgcttttctagtcatttgagatagatcattacattttttatatgaaacctttctccttttcttgtgtaggcatttcttgttctaaacttgtctcttaatagtgcttctgttgaatctcacagattttgctattgcatgatgtgatctttctttgttttaagcaatttcaaaattgtttcttttttatctattggttataaggaatatgttgttaaattttcatggatttttctagttttgtcttggcattgattttataatttatttcattgtgttcagataaaataatcagtaaaatttttattttttaaaatttgttgagacttgcttaatgtcctcatatatggttaattctggggatgttatatgtgctataaaaagaatcttacattctgcagctgttggttaaaatgttctgtaaatatcaactacttcaatttggtctatggtacagtttaaatctcatgttgatttattgtctaaatatctgtccaatgctgaaaaggtgatggtgacatcctcaactattattggacttaggtctatctctcctttcaggtataataatatttgcttcatatatctcagcggttcatggttggttgcatatatatttacatttttgtctttttgaacaattgattcatttattatcatattaagtctctcttttcctctcaaaattttggcttaaagtttgtgttttgctgaggtaagtgtagctatttctgcttgatttgggtttctgtttgcatagcatatctatttcatcttttcaattgcagtctatgtgtaactttattggtgagatgagtatcttttaggctgaatattgttgagtcttgttttttaatccatcaatctacgttttcagttgtgtaatttaatccacttattttcaaggtatttatttatttataggtaaaggcttattcttttatttttttctgtttattttgtatctcccttattccttaatttctctcttattacttattttgacagtttgatagttttctatactgataaagtttgattattttttctttcacctttgtctgttggctctatgagtgagttatataattttgtgtgtttttatgaagtgtattatcatcttttcaccttcagatgttagacttcctcaaatattccttttaaggctggtttaatggtaataaattctttatgtttttgcttgtttgagaaatactttattcctctgtctctgttttttttgtaggatcaaagtttgctttatataatattcttcattgacatgattataaaacaaattttatcacttagcatatattttcctattctttcctggcctataagttaatgctgagaaatccactattagctgaatgaagattcccttatagatgatgtgtcagctttcttctgccatttttagaacacctgctttgcatttgacttgataatttgacgatatgtgcatcagtgaagacctttttggattgaagtaacttggtggaactttcagcttcttggatctagatgttcatcttttgtcaataacttaagaagctttctgctattatttcattgaatataatttctatgctgtttatcttctcattctagaattttcatcatgttaattttttttcttttttacttagtgatgttgcataaattctgtaggattactttattctttttcttctttcttgtctatgtgagtcatttcaaaaacatggtaatagttggaaattatttcctctgctttgtctcttatgttcttgaagctctcaatagtatatttttaaaaaaatttgttcattgctttaaagtattttatatttttgtgggtacatagttggtggatatgcttacggggtacatgagatattttgatccaagcatgttctagtgaaaaatttttacaatgaacaattcaataaagttgcagaacatgaaattaacaagacaaaatcaataacatttctatttgcctacaatgagcagctgaaaaagaaatcaaaaaagtattcccatttacaatagtcacaaataaaattgaacatctaggaattaaaggactgaaagatctctataatgaaaactactgatgtaagaaattaacactgatgtaagaaaacactgatgtaagaaattagagggtaccaagaaatgaaaaaatattccatgttcattgattagatgaataaatattgttaacatttctatattaagcaaaacaatctactgatgcaataaaatcatgaaaataccaattacattcttcacagaaatagaaaaaaatctcaaaatgtatatgaaaccagaaaagacccagaatagtcaaaggtatcctaagcaaaagaaaccaacttggagtcacattatctgacttcatattacactacgcacctatagtaaccaaaccagcatgttactgccataaaaacagacacagagatcaatgaaacagaatagagaacccagaaaacaatctacacacctgcagtgaactcattttcatcaaagttgccattaacatacacagaaaaaaagacagtctctttaataaatggtgctgggaaaacagaatatctatatgcagaagaatgaaactagatccctagctctatccatatacaaaaatcaaataaaaatggtttaaaggcttatatctcagacctcaaattatgaactactacaagaaaacattaaagaaaatctccaggatgtttttctgggccaaaatttcttgggttataccccataatcacaggcaaagtaaaaatgaacaaatgagatcacatcaagttaatcagcttctatacagcaaaggaaacaatcaacaagtgaagagacagtccacagaatgggaaaaatatttacaaactatccatctgacaaggaattaataaccagaatatataaggggctcaaaccctctataggaaaagataaaaaaatggacaaagaatttgaatagagatgtttctcaaaagtaaacagaaaagtggcaaacagacatgtgaaaagatgctcaatatcactgatcatcagagaaagtcaaatcacaactacaatgagacatcttctcacaccatttaaagtagcttatacccaaaagacagacaaaaataaatgctgatggggatgtgaagaaaaaggaaccctatacaattttggtgggagtgaaaattagtaaagaccactatggagaacagttgacggttcctcaaaaaaatgaaaaatagagctaccatatgatccagcaatctcattgctagatatatacccaaaagaaataaatcagtatgtcaaagagatacccgcactcccatgtttgttgcactatttacaatagctaagatttagaattagcgtgaatgtccatcaacaaatgaatgaagaacatgtgttgcatagacacagtggagtaccattcagccatgaaaaagaatgagatccattcattttcaacaacatggatggaactggagctcattgtgctaagtgaaataagccaggcacagaaagacaaacatggtatgttatcacttatttgtgggatctaaaacttaattaaactaatgaacatagaaagtagaaggctgattacttgagcctgggaagggtactgggggcatgggggtaagcagggattttaacaggtatgtaaaaaggaataagacatactatttgatcacacaacagggtgactatagtcaataataacttcactgtacatttttaaataactaaaatagtgtaattatattgtgcataagacaaagtaaaaatgcttgaggggatagatactccattctccataatatgcttatttccaattgcatccctgtatcaaagtatctcatgtaccccacaaatatatacatttactaggtaaccacaaaaatttttaaaaattgaaaatttaaaaatttgaaagatatacttaatggaaaaacaagcaatttgtaatacaattattttatgtaataaacaattaggggacaggtttcaaaactattgacttggatttagtaacaacagtaagtattagcaattatcatgattgtactattagtcattctttcacttgtcctacttctctaccaactcttccgtttcctggtggcactattaatttcccttaatgtacatgggaaaattattaaaatataaagttagattgctttgaatttttattagtatttcatcaacttttatctcacgagaaagttaccatgtagaccttatataatttgcattcaacatggatattatgttttagccattgaataagattttagttgtatgttgatgctaataagaaggtaaacagaaatgatcccctaagagactgtataataatgttgcaaagaataattgctatctatatatatcttaaaagtgtgatattaatttaaaacacatgagattcttgtgttctctcataaggaatattctatagaataaataattgttattatgaactaagggcacttttcagatacaagtggtagaaattatttggtttttattaggcaagcacttttcatttttttcttggattctctgagatgcaggtatgacgttgagacataagttgccccagggagctttcctgagttgtcctgcaggcttggcataaggtggaaaaacacctgttcttatagggtaaaatgacctttttttgctgtaacatgtagacctctggaatctcagggatgaatggtttaaatgctggagtgaaagcaagtaaacactgggttttgttgcaaatattttgggggcacaatttctttttatgttgaagaatggtgtacattttaagctagaatactggtgaagagccccaatccttacaatacatcattagcatttcaccttgctcatctgtttgcaaaaacttctgcttctgcttttaaacaagtccacaggatatctgtcatctataacattgctggagaatgtaatgttgatgtgctagatgataatcagtatctattaaatgaggaatgatatctcaggtgactggcatatgataggtaattaatgttattggaaataacaaaaataaccaaaattgcaatattaatatttctggatcactgacttagtgccagacacattttaagtgttttacctgctttaacttttttccacaatacaatataaagctggcaaaagtacacataaatatctctatcaacattctggtatatttttctatcatttgctgcctgattttattaaaaaaattctaaattgtgtattctttttattctgaccctctgcagtctaattcattgaatatcttggaaactttttaaaggaaggaaatataatcagatctctccatttgttaactctttttagtagcttcccaatgccataataaatatttcaagatcctaataattatttggctccaacttgcctcttcagaatcatctgtttcttagtattcttctgcaaactaaacttgaagacttgagaactgtctttactactttgcctgcttttccttttgtgtcttcctctccccctcattcatcacctatttcttcacacctttcagttctcatcttgattatccatgtctccagtatactttctgttatcccaactggatatatccttgttattgtggtactgaagataatgcttttcacacattttattacttgcttatattttatctttcaacatagagtttaaggaatgtggggacagaaactatgtctacttttcttgtcttcttaaaatccaaagcagtggtttgtgtgaagcactttataagtattctttggttgaataactaatactttcttatatgttgcaaaatgaaggctttaatttgaacattactaggttcagatagtctctagtagtactcttttttctgtagtaataatgaaattcatataattgtgatgatatagaaataggaatctttaattggcatctggtttaccccacccactaaacatctttctttcacttcaagcaaaaacactgaaagaagaatatagtatcattcccaccaaaaatttaagacaaacaaaacaaaacaaaacaaaacaaacaggtttttttttttttttttttacctttggcagggattttgcaggtttgccgtgaagttttccaacaaagtgaacattttgtaagtgtgggtgaggaaattaaaaattcctgtagttttgaagaagctttgtttcacttttctccattatctcagataatgtagtattttttcataatgggaaaaaggaaaacaaaggcatatgacacaagataattgttatgagaatacaactgataattatctgaaaggagttagaataatgtagccaaagatatataaattgtctatgcttagataaaacaatatacatgtatttatacctggggataatttagtttttgtgcattatctattttgctcatatgtatttacaagaaagaccaagtgctaagagaattgtgggagaaaacttattcttctatcacatcagtgtattcgccatcgtaaaccataattaaaataaaccttagagaataaaacatgcatttgtttactctataaagcagcaatagtaatagatatacacttaaaacaagtctttgaggtccatgatcaatggattctactctactcataaaaaacaattttctaagaagtactcaatttttttcaaaaattaagctagtcccttgatcttttgttcttcaagtgaactgttgagtattttgtgagtatggctgaaatccttgtacctactactgctttgggttcatgctaaggtcttaataatgttagattttaagtaaacatattgtcaaatagcagctgaaattttttcagaaattattgaaatagagacttttgcctaacatggatttcactcatattgttcttagtgaagagacatagttaaaaaaaaaactatacagaagtaacttgatgttcacatttcaacagatgtttgactttaagacaaatgattttcaatcctttagtgaaggagtataaagatactagaaacttcaaattacctgcattgatttttgagtctttgatagagaaattgtatcgttcaattgtgaaggaaacattatggtactgtgggaaaatattttaatttctaaataagggacctgagatacacaattcaaaacaatcccctcaatgctaactagatagttgtgctagaaaaatgcataactcctcaatctacatgtctgcattcagcaggatgtttcttgatgtgtctaatgacttttcttaaatgaaaaatatgtcaagtaaaatggatgtgtgattgctgaaagaaatcctaatgacattaatttataggtttatgagttcctggagtgtgctgtattagtgatgaccacagggttctaacagatgctataatgtaagtctttccataatatttgtgagattgatagattattttatattttcatttcctcatttcttttattgaaaaacagtacttctctgactttatacgtacttaccttctgttttagttaattttcacactgttgacaaagacatactcaagatgggataaaaagaagtttgaaggactcacagttccacgtggctgggaaggcatcacaatcatggtggaatgcaaagagcaagccacgtcttacatggatggcagcaggcaaagagagagaacttgtgcagggaaactaccccttataaaaccatcagctattgtcagacttattcactatcatgagaacagcacaggaaagacctgcctccatgattcaattacctcttactaggaccctctcacagcacatgggaatacaagatgagatgtgggtggggacacagtcaagccatgtcattctgcccctggcccctcccaaatctcatgtccccacatttcaaaaccaatcatgccttacagacagtcctccaaagtcttaactaatttcagtattaactcagaggtccacagcccaaagtctcatctgagatgagacaagtgtcttctgcctatgaacctgtagaatcaaaagcaagttagttaattcccagatacaatgagggtaccagcattggataaatacagatatttcaaatgggagaaattggctaaaatgaaggggctacaggccccatgcatgccagaaatccaacagggcagtcattaagccttaaaattacaaaatgatcttttttgacttcatgtctcacatccaggtcacactgatgcaagaggtgggtttccatggccttgggcagctccacacctgtggctttgcagggtgcagcctccctcccagctgctttaaagggctggcattgagtgtctttagcttttccaggtgcatggtgcaagttgttggtggatctaccactcaggtgtctggaggatggtggcccttttctcacagctcctttaggcagtgtctgagaagcaactcagtgggagttccaactccacattttccttcttgaagtccctaggctacacagaatactgggacgatttttttctttctagcccaccaggcctgtgatggaaggggctgccgtgaaggcctgacatgctctgaagacatttcccccattgtcttggtgattaacatttggctcctcattacttatgcaaatttctgcagccagcttgaatttttcctcagaagaagttaactcttatggtttaatgtaaacacagtatattaaaagtctaagtatgtgcatggcaaagagacaaacaacttgctctttacttgagtctttaatgtcccttttatgtttgtaaatgctattatccaggtagtatcaataattttgcgtggatgagtcacttattttatgtaatatattttacaatagtgtcaagaacattcacagtgagaagttcctttagttctgcaatcactttgagatggaattaaagatgaaaataattatatgagtatatcagcatttcttggatattgtgcttcaaggaattttttggtaaaagttgacatataattgctatgctatacaatttactgattattttgtaaaatccattatttgtggtatattcacagaattgtacatccatgacaacaatcagtttcagagcatttttatttgtatcacaaaataaaccctgtactctttagtattttttcctcaccctgagtttctgcatttctcctgccctgctcaattgctaattaaatttgtatctatagatttgcctattctggaaattttaaaataaatataatcgtacaatatatagtttcttgtgactggcttccttcatttagcataacattttaaaggttcatttatgatgtagcatatgtaaggacttcattcctttttaatggcaaaataaacattttatatatgagcatacacattttatcgatttatttatcagttgatggacattaatttttccctatttttggctagtatgaataatgatgcttatgaacaagcttagtgtaactgtgttttcatttctgtcagatacatattcttagaagtagaattgctgtgttgtgtttccttgcatgtttagctataaaaggttaaactgtacgtgtaaacttttgagaaattgctagactgttttccaatgtggttgcaccattttccattcccatcagcaatgtgtaagtgttacaatgtctccacatcgttttcaacaaatgattatgtgtctttttattacagctaggctggtgggttgaagtagtgtcttgtggggaaaagaaagagagatcagactgttactgtgtctatgtagaaagaagtagacataagagactccattttgttctgtactaagaaaaaatcttctgccttgagatgcagttaatcgataacactagccccaaccctgtgctggcagagacacgtgctgtgttgactcaaggtttaatggatttagggctatgcagtatgtgctttgttaaacaagtgcttgaaggcaatatgtttgttagaagtcatcaccactctctaatctcaagtacccaggcacacaatacactgcggaaggccacagggacctctgcttaggaaagccaggtattgtaaaaggtttctccccatgcgatagcctgagatatggcctcgtgggaagggaaagacctgaccgtcccccagcccaacacccgtaaagggtctgtgctgaggaggattagtaaaagaggaaggcctctttgcagttgagataagaggaagtcatctgtctcctgctaatccctgggcaatggaatgtctcattgtaaaacccgattgcatgttccatttactaagataggagaaaaccaccttagggctggaggtaagacatgctggtgacaatactgctctttaatgcaccgagatgtttatgtatgtgcacatcaaagcacagcaccttttcttaaccttgtttatgacacagagacatttgttcacatgttttcctgctgaccctctccccactataaccctattgtcctgccacatccccctctcgagatagtagagataatgatcaaaaaatactgagggaactcagagaccagtgccagtgtgggtcctctgtatgctaagtgccggtccccagggcccacttttctttctctatactttgtctctctgtctctttcttttctcagtctcttggcccacctgacaagaaacacccacaggtgtggaggggctggcccccttcagtatctcattgttgattatatttccttggtgtctaatgatgttgaacattttgactttgcttataagccactgtattttttttcttttttggagaaatttctattcacatccattgcccatttttaattaatttctttttcttattaagttgtaagtcgtatttctgatacaagtacttcattagttatatcatttgaaaatagattctaagattatgtgggcttttgttttcttgatgctgtcctttgaagcacaaaagtactaaatttgataaagacctatttatatatttttcatatttgattgcttatgcttttgatgtcatatgtaagaaaccactgccaaattcaaagccatgaagattatcttctgtgtgttctttttggaattttatgattctacctcttaaatttaagcctttgacctacttttagtagttttgtaaatggcttgagaccagaagtcaaactttattcttttgtttgtgggcaatccgttattcaataagcatttgttcaagactgttcaattttttcattgaattgttttggcatctttgtaaaaaaccataaatatgtgggtatgtttctgggttctaaaatctattttgtttgtatatatgtctatttgtatgcctataccaggctcatttgattattatagatttgtagttggctttgaaagaagaaagtgtaaatcttccaactttgttattattattattattattttcagacaggatcttactctgtttcccaggctgaagtagagtggtgtgatcatggctcactgcagccttgaactcccaggctcaagcaatcctatcaccttagcctactgagttgctaggaccacaggcatgtgtcacctctcctggctaatatattattattagtattataaagacaagagtctccttatgttgcccaggctggtcttaaactcctttgctcaagtgatctacctgccttggcatcacaaagtacaactttgttctttattttaagacttttttggctatctttaggtttcttgaatatctttgtgaatttcagaattagtttgtcaatttactggaagaagccagttgggattttgatagggattgcattaaatctgtatatctatttggggagtggagtatggacactacaacaatactgtgttttaatctgtgaacatgagatgtctttccatttatttacatcttttaaatttctttcctctatgctttacagtatccataatgcaagttttacacttattttgttaaaattgattcctaatagttatattcttttggatgttatttgaagtgcaattgttttcttaatttcattttggatatttcattgcaattatgtaaagtaatttttttgtttattgatcttttatcctgaaaatttgctttgtttattgttccaatattttttctagcagattcctaaagattttctagatgtaaggtcatgtcatatgccaaaagtttaacttctttcttttcaatgtagatttatttttttcattttcttgcctttatcttgactagaagctccattaaaatattcaatatagataaagagtggatttagtctttctccattaagtatgatgttagctgtgcattttttacagataacacttaccagtttgagaaagtttccctctatccctactttacggggtactgttataatgaaggatattgaattttattaaattaatttttctgcatttattgagatgatcatgcagttttatttttctgttctaattacattttgtattatgttaatagagattttaacgttaaagcaactttgcatttttaataaaacttttacttattcagggtatataattgcttctgtatattcttacattcattttgctagcaaattttgtggatttctgagttcataatcataagatttatcgatctgtagtttttattttttgtgatatctttgtgtggttttactagaaggaattagttaaatatgttgataatgcatttttcttttctgtgatttgaaggattatttttgaggaattgttaatttttctgctttaaatgacttatagatttcaaaataaaggcatcttgacctaggcaattctttgtgggttgtattttggaccaattcagcctctctttttgttataggtctattcagatgttctgtttctttttgaatcagtttaatatattttcttgtctgtgtcttcctgtagtagaatttatgtcaaattaagttgggagtgggtgagggagcagttcatggttgaaattaataggctctcattatttttaccaggacttagtagattttcttgaataaatattgctaatattacgctttataattttaggtcaatgcctggacactttaattttttatagaaaacacaatattttaatgctaaagatgtgtttaaattgtttcttttttacaattgtgatgttctatgaagatttaaacttttgactgttaacagatgatttaaatagaaatgtagcatatgtactcagtgtacatgtgtatattcagcttgtcagcattgagttatctttcataaacttatatttatttatttgacacaaccaggtgggaggggttcccagagaaacaccagagagcctgtgcactgggaggagtgcacactggggtggagccacagaagttcatatgatttgcagtgaggaggagcccggcccctcctcttcttggatggaacctggaattcagtctgtgaggtggcaaacccaccggcaggaaaacacactctctcacttcactaagagcctctgttttgccttttcttcctttttacctaacaaaactctgcattattcaccttcaaagtccgtgtgcctaatttttcatggccatgtgacaagaaccttgcttttagttgaactaagaaaaagtcccacaacatatagatacacacacacgcacacacacacacaggcaaaaatgcaaaaacattcctcattttattttgttttacagatatggtcttttttacaaattgaaagcttattgctgccctgcattgggcaagtttaccagtgccatctttccaacaggatgtgctaactctgtcactgtggcacattttggtaaatttcacaaagttccaaacatttttattattattatatttattatgatgagttgtgataactgattgttgattttactgtagtattgtgttgcgggcaccagaaactgtattgggataatacgataaacttaactgataagtgctggtgtcttctgactgctctaccaaccagcctttcccccatttctctctctctccttaggcctctctatttcccgaggcacagcaatgttgaaatcaggcaaattagtaatcctacaaatggcctctaaatgttcaagggaaaggaaggctctgtcatctcaatatcaaaagctggaaatgattaaacttattaagaaaggcatgttgaaagctgatacaggctcagatctgtacctcttatgccaaatagttagccaagttgtgaatataaaaaaaaaatttgggaaagacattaaaagtgctacacatgtacacatgaatgatatgaaagtgcaacagccttgttggctggataaaagatcaaaccagtgacaatagtccccaaatttagacaaagcctaaaccagaacaaggccataattctctccaatgctgacaggggtgaagaagaaatctttgaatctagcagtggttggttcacgaagtttaagggaataaaccatctccataacataaaagtgcaaaataaaagaagctacagaagattatccagaagatgtagccaaaatagttactgaaagtggccacactaaacaggagatttttccttgtgtacagagcatctttctcttgaaagaagataacatttagcttttttatatcttcacaggagaagtcaatgtctagcttcaatgcttcaaaggacaggatgactctttcattagaggctaatgcagctggtggcttgaagttgaagccaatttttttttttttttgagatggagtcttgctctgtcacccaggctggagtgcagtggcaccatctcagttcagtgcaagctccacctcccaggttcatgccattctcctgcctcagcctcccgagtagctgagactacaggcaaccgccaccacgcctggctaattttttgtatttttagtagagacggggtttcactgtggtcttgatctcctgacttcatgatccacccacctcggcctcccaaagtggtgggattacaggcatgagccaccgcacccggttgaagtcactgtttatttaccatttggaatatcctagggccttagataaattattctaaatctactctctctgtgctctattaatggaatatcaaagcttggttgataacacatttctttacagcataaattactaaatattttaatcccactgttgagatctattgaccagaaagaaatattcctttagaaatattagcattcattgacaatgtacctggtcacccaagagctcttatggagatatacagggagatcaatgttgtttttatgcctggtaatacaacattcattctgtaacacatatatcaaaaagtaatttcaacttttaagtcaattaaggaataagtttcgtaagattattgctgccattaacagcaatttctctgttggacgttgtcaaagtaaattcaacactttctggaaaagtttcacctttctagatgatattaagaacatttgagtcattaaatgaagtaaacatatcaacattaacaggaatttggcagaatttgatttcaaatatcatagataatgttgagagcttcaagaattcaatggaagaagtaaccacagatatggtagaaatagtaagggaactattactggaattaaaagaagaacctgaagttgtgactgaattgctataatctcatgataaaacttgaatagatgagttctttcttatggatcagcaaaaaaatttggtatagtgagatagaacctactcctggtgaagatgctgtgaacattgttgaaatgacaacaaagtatttagaatattacttaaggttatttgataaagcagcagtagggtttaagtggattgattccaactttaaaagaagttctatcatgagtaaaatgctaccaaattgcattgcatgctgcagataaatccaagtcaaaatcacaatgagatgctaactcaagccagtcagaatggctatttttaataagtcaaaaacaacagatgctggtgagattgtggagaaaaaggaacacttttacactgttggtgagagtttaaatttgttcaaccattgtgaaagacagtgtggtgattcctgaaagacctagaggcagaaatataatttttcccagcaatcccattactaggtgtatacccaaagtaacataaattgttctattataaagacacatgcatgcatatgttcgttgtggcaatattcacaatagcaaagacatggactcaacctaaatgcccatcaatgacagactggacaaagaaaatgtggtacatattctccttggaatactatgcatccctaaaaaagaatgagatcatatcctttgcagggacatggttggagttggaggctgttattcatagcaaaataatgcagaaacagataaccaaataccacatgtcctaacttatatgtgatagctaaataatgagaagatatggatacatggggggtaaaaacacacagtggggacttttggaggtcaggggatgcgaggagggagaggatcagaaagaatagctaatggattctaggcttaatacctgggtaatgggatgatctgtgcagcaaaccacgatggcacacgtttaccttgtaacaaacctggacatcctgcacatgtaccttgaactttaaataaaagttggaaatttttaaagaaggaaggtcaatgggtgcagcaaacattatttttgtctttttaaaagacattgccacagctccccaaactttcagcagccaccaccctgattagttagcagctgtcatcatcaatgcaagaccctccacctacaaaatgattacaactcactgcaggctcagatgattgttaggatttttaaagcaatgaagtattttcattacagtgtgtacattatttgtaacatatttatattgcagacttaagagactacagtatagtgtacacataacatctatatgccatggaaaaccagaaaattttgtttgacttactttacttcagtgttctgggaccaaatctgcaatatcttggaagtatgtcttgtataagtgaacataaaatgagatctactcttttaaaagtattttaagtgtatgatacattattgttaactatggccacaatgttgtgcagcagtgctctgaaacctgctcatcttatttttactggaactttatactcattgaaaagcaactctcaatttcctccattctccagccactggtaacctccattctactctccgtttctttgagtttgactgtttcaaatttcttacacaagtagaatcatagagtatgtgtcccattgagactggcttatttcacttaaaattatttcctgaaggttcatctatgttgttacatattgcaggatgggtggatcatatggaagttctatttttaattttttgagcaacctctacactgttttcattttggctgtaaaaatttatattcacactgacagtgtatgaaagtttcaatttctccatttcctagccaacaacttttattgtgtgtgtatatatgtatgtgtgtgtttgtgtctgtatgttgataaagacatggtaagaggtatgaggtgatatctcattgcagttttgattttcctgatgatgaatttacattaattagttttcatacagctgttgtccatatgtacaacttcctcagagaaatgtctttttcaagtatttgcctatttattaatcatggctttttttctctttttgctattgagttgttgcagttcctaatatattttaggtgttaacctctcatgagatatatgatttgaaactgtttcccattcccattttatcttttcactctgttgacttctttgccctgcagaaactttttagtttgatacaattctactttcatatatttgaccttgttacctgtacttctgaggtcatacccaatagaccattgcccagcccaatgtcataaaactttttccgtgttttattgtgagagttttatagtttcagggcttatgtttaagtctttcatttgttttgtgttgatttttgtatatgacataaactaagggtccaattttattcttttgcatgtggacatctggtgttctcatgcagtaccgtttcttgaagagagtgacatttattgagtatatttgagactcattgaatataagtgcattgtatatttgtgactttatcatctgggctctctattctgttacttaaatctctctctatttatgtctttatgtgaatatcatgttattttaataactgtagcttttaatatattttgaaataaggagatgtgatgccctataactgtgttttacttttcccacattgttttggctagttacttcttcctggatcattatacattttaagatttttttgtctttgtataagtcattggtgtttcgatagagattacatttaatatgttaatcactttaggttgtatagatgtttctgtaacattaaatcttccggtcaatatactatgtctttctaaattagtataatctttaatttcattcatcagtgttttgtagtttttagtatacatgtctttcttccacttgttacagtttattcttatgtattttgtcctttttgaggccattgcaaattggagtgttttgttaatttccttttctgatagttctttgttaatacacagaaaggtaagtgatttttgtatgctgattttatatgctgcaaatttactgaatttatgcacttgttctaataatatttggtggcatctttagggttttccacatataatatcatgtcctctgcaaacagaggttattttactgttgattcagaagcctgttgctttttttctttttcttgcctaattgttccggctaggatttccagtatggtgtataatagaagcagcaagagtgaacatcctttccttattgtgaaaacagatgaaaagttttcagtttttttttaatcattgagtatgatgttagctatgagcttttcatatattgcctttatcaggttaagataatttccttctatttcttgttgcaggaagtcagggaccctgaatggagggactggctggagctgaggcagaacatcataaattgtgaagatttcatggacatttatctgttccaaaaattaatacttttataatttcttatgcctgtctttactgcaatctctgaacataaattgtgaagatttcatggacatttatcacttccctaataatactattataatttcttatgcttgtctttactttaatctcttaatcctgttgtcttcataagttgagaatgtatgtcacctcaggaccactattgtacaaattggttgtagaacatgtgtgtttgaacaatatgacatctgtttgtaaaacatatatgtttgaacaatatgaaatcagtgtaccctgaaaaacaacagaataacagcaattttcagggaacaagggaagataaccataaggtctgactgcctgaggggttgggcagaataagccatatgtttcttcttgcagaaagcctataaatggatgtgcaaggaggagaaataccgctgaattcttttcccagcaaggagtaaccctggggaaggaatgcattcctggggagaggtctatgaatggccactctgggagtgtctgtcttatgcggttgagaaaaggactgaaatatgccctggtctcctgcagtaccctcaggcttactaggattgggaaattccagcctggtaaattctagctagactagttctctgctctcaaaccctgtttcctgttaagatgtttataaaaacaatatgggaacagcaggacatagagcctcatcagtaattctaattctgcctttgccttgtgatctatatggccctttgaagcatgtgatccttgtgacctactccctgtttatacaccccctcctcttttaaaatccctaataaaaacttgctggttttgcagctcagggtcgtctgcacagtcctaccaatatgcgatgtcaaccctggaggcccagctgtaaaatttctctctttttactcttactctttatttctcagaccagtcaccaattagggaaaatagaaaagacctacattgaaatattgggggcttgttcccccgatatcatttctatttctagtttgtttagagctctcttttaaaaactcataaacaattgatttttttcaaatgctttgttttgcatttactgatatatcaagtgatttttatgcatcattgggttaaggtgatatgtcacatttgctcatttttgtgtgttctattatccttaaatctagggataaatttgtcatttcttttaggaaagaagcaatgctgagtcttgaacatagtaaaagccaagcaacactactggtcttgtaatatcaaaaggaagagtgagactttcttcacaatttaattattgagtagtttctttgcaacagtaaaaacaacaaaattctgctgaaaatgaaaccaaagaattctgagtatttgcaaaatggtattaatattgtgaacggatgtcttaatattgggtcaatgtataaagtgtgaaacacagctcagtaatttttgtgcatgtgccacttgtgaatagaataatgtatttcacataaacccatatggttttacattattttttatttttccttgtttttaagtatttgactaagaatatttctaacttttaaataggtactaaatctctggaaaataaattttgacctaacagtgtaagttataaaaatatgttttgtcacaggaggaaggaaatcctctgtatcaacctcttcatgctggaattaactgaaggaattctatcttttggtcattccagcttcaagccttttatgtaactaatcccttttctccttctttcctgttttagcaaactttcagaaagaaaacaggcaacatcttgtgatgatgaagatcacagttgacacataggccagcaggaacctaatcacatgcaagttgtggtattggaaccaggtgaggtcgtgggctgcaacccgaaggtgcttggctcctttgtgctgcatgacaaactcaatccagaaggctgcttgatccaggggcttaattggcaaatcatggcgaattattgataacttcatagcattctctttgtagctgaaggataaacataaaaataccaacattgaaagtaaatttatttcctaagtctatggatggtctttgaaaagtgtcacatcaatgcttcaaagtaaatattatagaattgtcataggaatcgaatgttttggtttggacaaatgtagaaagtttattttttaaaatggaattttataaagaaaaatatgtcttaaattaaaaatggaaggtctgatgagaaagttaatgtctttgtagcagaggaaatattttgagccattctatgtgctacaggtaagacagtggaaatgcaatctgagattgatcatcttgatattttattttatttttttttgagaaagagtctttctctacggcccagattggagtgcagtggcatgattatgggtcacagcagcctccacagtgtgggcttaaacaatcctcccacctctgcctcctgagtagctgggactgcaggcatgcaccactttgcccagtaatttttaaatatttttttgtagagatggagtcctaccagtttgcccaggatggtttcaaactcttgggctcaagtgatccttttgctttagccttccaaatttctgggactacaggtgtgaactacctttatcgacccattttgatatttttaaggaaaaattgtttcacagctggtgtaatatttctaaattagtctttctctttctaccctactattctgtgttctaccatattttcctctcagtagtcagaataattttttgaaataaaagccagattatggcattcctctgataagattttcacctggcttctcactatattaagaataaaatctaaatctgtctttgttctacagaaccctacatggtcaggcatgggcaacttcttctaacactttccccaaccaccttctctcctagaggcattgcccttctattgttctttgagctccccaatgtgttctcacctgagcccctttacaccctttatcccctctctccctctcttggaatattcctccttgcaacaacttgaggcttgcttctatatctttttgaggcttccccttaaataatacctgttaaagaggcttttcgtggccacactatggtagtacctgtaggatttcctctattgttttgtgcttattttgctgtttaactcctggaacttaaaaatatgttacatgtcttctcaaataaaactttaagtataaaatacataaatgtacacaaattcagtgaatagctcaaaattttaacattaccttgaacaatatcctgatgtgaacaccaacttacctactacgcagattataatataagacatcacaacctgcctagaaaaactctgtcttcttgggccattttagtcactacttttgtcctcaagttaaaactaccttgacttctaatagattaatattgcttgtttacataatgaattatataatatatactcatttgtgtctttttttgggtagaagttattggctaattccattgctgtaatatgattcagtcaattgacaaataccacagattatctcctatttttatgactgatggatatttgggttgttaagatttttgaacactattactaattctggggtaagcaaatgtgtgtatatcattagatatacatattaatacatttttgatgggtatatacttgagagatgagttgctgagaaaaagatgcatgtagaattatgatgttttgttgactagctttttaaatacacaaatttaatttccaaaatttagagttgttttttaagttataattttttggataatttcgaatttatttctagtatggctagagcatttcctttttatgcttttgaatcttatcacatttgctaagtcctgatttttggcccagcagaagttcaattcactaactattccatatactcttaataaacgtatattctcaatatacattcacactcacctccacacctccacacataaaaatgtgtgtgtatatatatatatatacacacatatacacaaacttactatatatatacacaatacatatatatgtatacacacacatatatacaataggttatatttatgctcttcaaatgtttatttttaagtcacttttttttctctgtttaaatttagtatgagttctagtagattcacttttaaatctactatcttattctgtattttattttctgttttccaatctgctgtatgtttcttttctaattctttcctgtttgcttttaaactatttttaatcattcactgtcttattatcttcctggtaaggtattttcagtatattttctaaggtggtacctccttatatatattgataatagtaatcaatagtcacagcattttctacattatttcttttggagcacagaaaaattattacagatttattttctcaatattaaaactttgtgcttcaagggacatcttcaataaagtaaaaaaaaagaatcaacctataaagagtgggagaaaatatttaaaaatcatagactgacaaggcattccaccaataatataaaaataattcttatgaatcaataataagataaaaatgttagaaatgttcaaaagataggaataaaattttctcaaaagaagacgaatgacttgccagtaagtgcatgaaaagatggttatgtctttagccacaaggaaaatgcaaattaaatccacaatgaaagatcattttatatccactgggatccctgtaacaaaaagataggagataacaagtgtagggaagagcatgaagaaattggaaccctcctgtacagctagaagtaacgaaaaacggtgcaagtactttgaaaaacagtttagcagttcttcataaacatcaactttccatatggctcagaaattccactcctagtatcttctcaaaattagtgaaaacaacttttttcacaaaaaatatgtatagcagtgtttataagagctaaaattggaaataactgaaatgtctgagagctgataaatgggtaaattcaaaatggtacattcatcaaagaatattagcaataaaaagaaaaaatgttctgacactttcaacaatatgggtgaaactaataaaagacattgtactaagtcaaagaaatcatttatagaacactgtaaattgtatgatttaatttacatgaaatatccagagagaataatctattgagaaagtaagttgatatttccctaggactggaggtttatcaacagtgattttatgcattttgaggtttattttagggtgataaaaatgttcaaaaattatattatggtgatggctttgtaactatgtaaatgtactaactacttttagatctcacttttaaataggtaaatattatgctatgcaaattgtatcttaaaataatgataatactaaaaatacattattgagcatgaatacagttatactttcagaaattttatgtattgaattgaaatactttattttatttctccaagttcattatttcattgtattataatccatcattcaaaaaacttatattttaaacaattatctatatatgtttaaaaatatttgtgtgtagaaggttgttacagtaattggtgacccattaaatatatgggatcaaatgtaactaaaataattggtgaaaaataaaagcaggtttcaagttggttaaattatttaaattctttcaaaattggtctcctaaaaggggtaagacatgtattcagtgttgtcaaaagaatctgtaaataccacatagtaaaaaaaattgtcatactcacacagggtcattaatgactgtcttcagtgcattgagcaaatctgtacttgacatggtcctgatgtccacattgagggccttcatgtgagcaatgttatcaggttgatctgcaaacaaaggaatgcccaccatagggatcccatggtagattgcctcatagatgccactggtttcaccatgagtcataaaagatttagtttttggatgacctaggattggataaattttagcaaaattattcataagactaaaatgagaaatgcacaatagaatgctctgaaaggggcagtgtctactaaataacagattattatacacatcaaactccattagaattgctttcggatttcagagaaagaagcacctaattcttctggaggtaagtgaaggctacatgaagaggtgggggcgtgtgtgacttcagactcaaaaaatgaattgatattgccaggtggacaaaatgaaaaagcacattctgaatgaaaaaaatgtgcaaaaaaaaagagaaaagaaaatcaataatattgtgtatgttagagcattttcccttaaatacatactgcggtctgagtgggatatgtggtgtatgcaaggcaacagggagtgtggtggtggtattggaatagaagaaaggcaggccacattacatcaggaaacgtgttatcactttatgataaagattgaggatttaggccgggtgcggaggctcatgcctataatcccagcactttgagaggcagaggtgggtggatcacctgaggtcaggagttcgagaccagcctggccaacatggtgaaacctggtctctactaaaaatacaaaaattagagaggcttggtggcaggtgcctgtaatcccagctactcgggaagctgaggcaggagaatcgcttgaacctgggaggtgaaggttgcagtgagccaaggtcatgccaatgcactccagcctggggacaagagtgagacttcatctcaaaaaaaaaaaaagattgaggatttattttcagaaaatgcagagttattggtaataaaagaggcactgttattttttagtgtcttttgaaattaaccctgaagtagggaaaaggacaggtgtaaagctgtacaaataggagacagagagacaatccaggaagttattgggaaaccccgtgagaggtaattatatctgaaataaagataatttgattctgaacataaagaatgtgagtgtctataataaaataccaactatatagttattttcctggtaagactggaaaataaatataaagtagttagcctttatatttgagttttttgataataaatgttccgtaagtttctttcaggttgagctatccttctaattagctgttagtcatatattcagtatttgttctgcagagtattaccaagaaggtcattctgggatatccacttgtacagctgagtattggatgctaaagtatttggtctctttccatccacagaacctgttggggtaaagaaaatatcttgttccatgagtagaatgccaaagctataagatgttagaactctaaagaaattgtcaatcaactagttaaaccccttccatataatagatgaaaaaacgagaacaagcaattttaggaaatgagtactactaaaagactattgaatatccacatttcatgtcttttattatcaatttggtatattagaaaatcatgatgttttcaacagagaagcttagacacttgagagtatcaataaaaaattcaaaaatttaagaaattattagacagtcattataattctactgtaaaatacagtaacaaattagtgacaacctatacatttattttatgtattttatactacctgtaatcttccaaatttaatgttagtttatttcttgagtgaaatgagaagtgttacttatatatatttttctgtaagttattttgttagtgtttgacatctttgatttataaaaaacaaaatctataaaatcagctacctgtgagaaataaatcagtgctacataggtagtacatataacttcttgtagattacacattacccagcactacatccaagaaaaatttcaagtgacaatttctttcttttcttttcttttttcttttctttctttttttttttttttttttgagatggagtcttgctctgttgcccaggctggagtgcagtggcaccatctcagctcactgcaaccctcgcctcctgggttcaagcgatttttctgcctcagcctcccaagtagctgggattacaggcatgcactgccatgcccagctaatttttatattttttagtagagacggggtttcaccatgttggccgggctggtctcgaactcctgacctcaagtgatctgcccacctaggcatcccaaagtgcaagtggcaatttctgagtcaaattcaaagtactatcattttgctagttttggaaattcttccaatgtaggcgaaaagagccaattggcaatttatgaataagaatatacacactaaaaattgtaaaattatattttgctaaattttgcttaactgatcattaacacttagatgctgctataaagcatcgacagcatagattaatatgggctgctttagccaagccatacccatagacagtaccaaaataagatactgattttagattccccaagcaatccttataaactggagtgtaatttacaagtgttttccttgtatttgctatgtgagtgttaaagtaactttgtgtttccagaaaaaaattagcataggtcattaggagaaggctatgtcagagaggaaactaaaaagtaactcacaaatacacaaagacttcaagtgtattctgcatactacaaaataagttcctactatatttcatggagtgagggcatctgaacctctttccatgcctggcttccttctgcttgactccttcttatattcccttctccttcctccgttgggaggaggtgtttttctgatggttagagcagaggctttatgggaccacattttataatgcacggagtctaccctaaaagcaggattctgttccttccttttctatcatattttcctgtttaagacattagcaaggcccagtaaacagggcaggcaagttcttctgcttctctaaatctacttggctaggtggatacctccagaatagcggtttgtcagcctggacatcttttctctgaatgcattctgaattgcctactaaataggtctattccaaaatgtacaggaagtacaggagaccagattacctagcaagcctaaattgaatgatgcatttcagacttttttcaataccttattgttattgtaatagtgcagtaactgattaaaatgtaagtgattttaaataatatctatagtgtataccatgttctcaggaaacttgtaagcaaaagggacaaatgacagggcagaatttggtgatttctatgtacatgcctacaatactatgataataccacaacttcacctgcacctcttaaatatattttttctgatcacaatattaatgtcagaatttttatcaatcaaacacaccctcgttattttagtatcttccatatatatttttgtttttgaaccaatatctgagataattagagctatcatatcagttagtttttctggcagaaaatttctgtgattggactctttacagagtttaacagactcattcagtagctgtccaccattaagacattttatctaacctttcgtggaatctgggcaagagctgatgcaatcacgttggccctttcttctgtgatgttactgaccatagacttaagcaagactgccacgacaccattttctccagagctctgcacaaactcttccattttctgtgaagaatttgttctatcacaaaagagtgtcagcatagcaaacactatagaaaagattagtacatacatctaagaagagaaaatcaagcattatcagaaatttttggagtaatggctattttttaactgacctaatctctttctttggaagaagttatggaatatgatatacatggcatctgttatggctatttgtgtaaatatgtgtgtctgtaaaaggaaaagatgaaaaacaactatgacactatagaagaaggagacaatgctagaaaatattatacccagactcttcatttacaatactgtaattactaatatgggttcttggaaggtggcatttgttgtgtttaattccatatgttgtagttctactaaattccttgtgtctattaaggcagggttttttgtttgtttgtttgtttgttctttctgtagagtatttttagttgggagtcattggaaccattacctggctatgagcagtgaggaaaagttactattgaaataattttatatgtctatttctttagctctgtaattctttatacctcatttaaaacttgtcagattatgtctttttccctaaaaaaaaatctttaaaagctgaagtttaataatgatggagattcaagagtctgatactgtggtgtgaaatttctgtgaactagtcctgagaatcccatttataatacagaattatgcagtatatagttacataactgagtgattgtatttctcaggtcattgtttaaatattactaagacactttttttcctgaaatcacactgcataaaatgatatgctactggccaggcatggtggctcacacctgtaatcctagcactttgggaggtcgagatgggcagatcaccaggtcaagagattgggaccatcctggccaacatggtgaaactctgtctctactaaaaatacaaaaattagctgggcgtggtggcacacacctgtaatcccagatactcgggaggctgcggcaggagaattgcttgaacccgggaggtggaggttgcagtgagccgagattgtgccgctgcactccagcctgggcgacccagcgagactccatctcaaaacaaaacaaaacaaaacaaacaaaccaaacaaacaactgatgtgctacctataactgcctgtgagggaccctcatcatcacttttctgtgtctcacaggggcacttaatcctcagtggaagaatctaccagtcatttttccagtggagatctcttcactatcttgagtagctcattcacacaatataaagcccttgttgaatatgtgtttgcttgaaatttattgagaattactctgaattgtggtttcccttatgttctcatttgtaaatgtaaatgcatagtgtaattccacattgctcagtgcatacgcctatcaagacaaaataaagagaaagagaaatgtagcgccaaaagttttcagtatataatgtcaaaattgaatacccatctttttgttgttgttgtttcttttgttttccatttattatttatttattttctctgtaaaataatgatgaacccattctgacataaccggtatactttcagatcctaaacatgggaggtaaactttcttttaaaaacttgtttaaaaaaagaaatcctaaagtttgtgtatgcacaacatattttgccaagtatttttcaaaaatataatttgagccttatgacattagttttaattggagagtcactgtactactattccaggtagttcttggggctcccaggtattctgtgtgactcgttacctgtgtgaacacaaagtatctgaaacagttctcaatttagaaagtttattttgccaaggataaggacatgctcatgacactgcctcagaaagtctcaatgacacgtgctcaaggtggttggggcacagcttggttttacacattttagcagacatgagacatcaatcaatatgcgtatgacgtacattggtttggtcaggaaaggtggggcaattcaaagtgatgccttcatgtcatagataagagttaaaaggttgcattcttttttgggtcttagatgagccttttgctgaatacacagtatacatatgagagaagggttgagaaatagtcacttatgccttagtctgactcagtaaatctgcattttttccataaacaatggtgaagggatggctttgagttctgtcctcttttgtccctcacctgtgaagataagctatcaatttacatttccagggtgaaattcaacagaaatgtttcaggttaaagattttgaggcccacaaggaatttcctcttgggaagattgtaagggaggtatgtaacttaaaaacaacaacaacaacaacaacaacaaaaacccaactttgtagctattttatttaggaataaaatgggaggcaggtttggctgatacagtttccagcttgacttccctttgacttagtgactttgggttttcaagattatttttctttcagacctgtagccacatttaatggaacttgtgtttgatgttttttctcaatgcctcgctgcccagagtcttcttcatccacccaatattgaggtagcatattgtctgtttatacactcatcagtgatctcattctgggatatcttcatgaaaataatatatcagtgtacaaaatattagagtatgaaaagcttaaaaaaattaaatttccctcatactctctgtctagagctattcctgatttaaatttgtatgcttttattatggtttttattctatttatataattcactgtgatgtttatttagataattttaatcttattgtatattccttttcatcctgcataaaaattgtgatctagttctattcatcattttgtttctcagtttccgacaattcttgtattatagctgacactgtaattatacatattttgataaaatgattgtaatggcatagaatgcatattgtatacatttttacatagtacccaatagtttttcaggccttctgcccttctcttccctctgtagtagtccccactgtctattgttcccatttttgtctatgtgtgccccaagcttagctcccacttttaagtgagaacacatagtatttagttttctgtttctgggttaattattctggttcatgtgtgtgtgtgtgtgcacaaatctccatgtatttgtttgtttatcttggctttaatctgtcattttattttcttttttcaaatgttgtctgcctatctatctatatatttatctatctaatctatctatctatctatctattatctatttatcatctatctatatatttaagaatgaggacatagaatgattcactgggatatctttgtatctgtgaaggacttagtatctggttggctttgatttttatgctgaacgcgtacaactactagaccttacctaaagggaaccaaaaatttcataaaaaagattatactttgatgtgttacatcaattctagttttctcattttaccctggtgaatttatttcaatttctttaaggaaaaactctctagtttttgtgtggaaagtgcaaagaggaacgtattatgtaatacagtaagggttagtgcatttcattttcatgtctttagtttcctttagtctgtaattatcccttcattttttgtctctgttaatttttgacttctagatgaattattgaccagttgttttgtagaatgattcttattttacatttgtttaatgttccttcatgattaagttgctatcacacattttttgaaagaatactgcagacatgttgttgtagtcttcacattacatcatttttgggcagcagatagtgttgatttgtcatgctggtgatactaactttgatttcttggttaagatgctgtctacaggtttattccctgtaaaattataatttctcattttggaattagaagtatcttgataggagactttgagactgtaaatatcctgtttccattacatcctttccctctaattttagcatccattcaaagataatttttgcctgaattaaattactgtggagtttgtctaatgattatttctatgtctataatttctttaacaattagtaagagaaattctactctaagaaagaacattttttcccttttatttccttatactggtttctgtcaatatgatttcatgagtatttggtttattccaaaggttacaatccacagctatcattattccattgctcaaattggtccagattcgattcattgggacttccttcagtttccctctatatttttctgatatgttgtcatcatgttgtatacttatttactttctggcacccctagatatttcaggcacatcctgtacttttgttgcctcaggggtaatgtcatttatatcttgaggaaggcatggttcgttttattggagtatagtgtctagaagcaaaatttcaagtacttagcatgttcattgcatctgggatattattacttctaggccatttacgcatagacattttggaaatgtatctatgcataacttttcattaacagcttaagagaataaataaattatcatttccataaaatacagaaaaaggagagtgtagtaagctaaaacatggtaaatctaaatagtaaatatttacagataagctcaaactaataatttaatgtaaaaagttattttcatttaatgtcatgtaatagttatatatcaatttaaaaaagaattaaataaactcacccattatggtagagattctcagatatttcaatctagcttttatttttgtttaaaagagaaacacctaataaaaattacccatattactataaaatatatacagattttacaagaggcatatacccaatagcaaataaatgaaaattgatgcaatgctacaaaaatcaaacaaagcagaattaagatgcgaagtatcaaatgtgataagtgaatcatttcatgtggatagaaataattcacttaaaattaacaataataagtatttggagattgaaatatatctcagaaactgatagattgaacagagaaaataaattctatgaaagttgattgtattagcaacaaaagtaacaaaaataacgtactgaatcctgcatcttcaaatagagtataaatattcttttgaagtgcacatgaaaacttttataaaattaaactaaggcaatgtcacagatgaaatctccacaaattctgaagtatatatatcatatgtatctatataatgtgatacaattaaaataattataaacttaaagagaatgtattacctttcaaatatacacatttaagaatttcattcagtggagtggactgtgcttaccattcatgacccaagtctttactaccttttctgctccaaacacatataccatgaagagaagacggcatagaatatactcaggtaagtatacaactgagaaaacttacacaccagttgttagcattagagaaaattatatgaatagattcttataggagctataacaagatggttttggcaggataaaaaatgtggcaaaagccttaaaagtggaaaacaaaatttacctacggagttcagggaatttctgttctgaaaaaatgtaagttgtaataactaaaaaattaaaacaaattataatgaaactgatctctctagatgacagcagacacatgcaggaaatgaaagtttgcagaaattaacagctgttgaagattaactcatgaaaaccacatgaggaaataaccaattctacacaatagtaagattttcacccaaagtttataaatataggaaaaaatcaaaataattttttttctcagagatgagaaaatacttaacataaaaatggaattgggtgagaagcatgaatagaaagaggaacatttagaaattgtggaaattagaaatacagtcactgattgtataaaatgtaatagagttcacaaaataaaatggaaccgaatgaacgaataaaagaatgaacaaaacctgcaataaggtgaattagtaaactttctctttttctgactgaaccttgactgatagagcttccaacagaaatcacctaatactgtaggaattgccattaagctgattaaaatatgaaagtgttatttgctattaccacatgttagagccctcctgattgcctgctttacttctgaagctctgtcattatggtttcctggttttaatcactcattctatgcttcactgaaatattttgaactgattcaatgtgtttctctcaaatttaattttattctatcctgtctcttgcctcctgcaggttctcactgtgagcaatccagctccagagcttaccttctctgacctagggttcctcatttttttttttttaccagtttatctgaacttcattgatcttgttcctttgccaatcactctgagccactgtcatcatgactcaggattctagaatttgaacaaattataaatttgccctttgtatcttctgtatcccaaagaagaaccagtagacggtaccacaagagaaaaatgagtgcagtacatgaacaaaacacctgaatgaatcacaaacaaaaagagatggttgattagatttataattaagcatttgccaatcaaatcagtgattcatttttatattatttggattggtaaaatttaacatccaccatagatgaagcacgaaataactgtccactccagtgctgcataggtgggtgtacatagagggaggtagtgtttgaaggatacccctgggctcaactgactcaagctagctcagtcttggtaagagggagactggacacttctggtacagttgggctgcagacacactgtaccaactgtaagttcactttggtgagaatcttcatatgccctcacttgaaagaattttcttttccagataagtttatgccttttattcatccgaattttaccatgatgctgtgctcaaagatacaacaacatttgaggcactaaaaaatgaaaaattttaaatattgttgtctgctctaacagttttcaatttactgaaggtggaaattttacagttattaagaaataaagtaaactgaaaaaacataggtggagtgagactgagagaaaaagaaatggagagagtcatggaactcttcccagcagggtgaaaattattggatatttattaagaaaagggatgaatgaaatgaaaattaacatggctaaaaaaaggtctcaacacaacattatgagaggtaaggtggtcaaatgagactttttgaaattaatccaacctaaaagggccccaaactaatcagtttcatttatcgcagtgtggagtagtttaaaaagcaggaatgcagagatcacagttagaaagctgcttaataatttcttcagataatgctgaggcagattaatcaagataaaaattaacacacaaaaaaagggtttattggtttaaggccctgctgttgacccaaagccttgtgtaagactgtcaggggatagggaacagaaattccagagactccttaatacaagaccccatgtgatatgctaccaagatgcattggggaagccttgaccgaggttatagttaggttgagaaaccataaaaatataaagattaatagaattatgaaatttgtgatatttaaacaggcttaatttaaagaaagtgtgtctttttaacttaaatgtcttatgaaatggactttatgtctggctggaaacacttgttctgcctattgataatattgtaacacaaaacctgctgataaagtcctaaaggagcttaagtaaaggttaatgaaatgaaaaggaaaatgtataggaaagttggtatttttgaacatactttatgtgaagtagtatctattttatctgaatgtgtcaaggttgaaggacactgtatctaactaggaaatgtttcttgaatctaatattgtataacagaaggtatgcaaatttgcccttcagccaacattaattggacatgctaaatgaaaaccactatggtagggtggagtcaagatggccgaataggaatagctccagtctacagctcccagcatgagcgacacagaagacgaatgatttctgcatttccaactgaggtaccaggtgtatctcgctgaggattgttggacagtgggtgcaggacagtgggtgcagtgcactgagcatgagccaaagcagggcgaggcatctcctcatctgggaagtgcaaggggtcagggaattccttttactaaccaaggaaagggtgacagatggcacctggaaaatctggtcacttccaccctaatactgtgcttttccgatggtcttagcaaatggcacaccaggaggttatatcccacacctggctcagaaggtcctacacccacggagtctcgctcattgctagcaaagcagtctgagatcaaactgcaaggtggcagcgaggctgggggaggggctcccacaattgccttttgtttggctatgccctgaccccagaggtggactctacagaggcaggcaggcctccttgagctgtggtgggctccacccagttcgaacttcccagccactttgtttactcaaaaccgctcaactatatggaaactgaacaacctgctcctgaatgactactgggtacataacaaagtgaaggcagaaataaagatgttctttgaaaccaatgagaacaaagacacaacataccagaatctctgggacacattcaaagcagtgtgtagagggaaatttgtagcactatataccctcaaaagaaagcaggaaagatctaaaactgacaacctaacatcataattaaaagaactagagaagcaagagcaaacacattcaaaagctagcagaaggcaaaaataactaagatcagaatggagctgaaggagatagagacacaaaaaacccttcaaaaaatcaatgaatccaggaactggttttatgaaagaatcaacaaaattaggagactgctagcaagactaataaagaagaaaagggagaagaatcaaatagatacaataaaaaatgataaaggggatatcaccaccgatcccacagaaatacaaactgccatcagagaatactataaacacctctatgcaaataaactagaaaatctggaagaaatagataaattcctcgacacaaacactctcccaagactaaaccaggaagaagttgaatgtcttaataggccaataagaggctctgaaattgaggcaataattaatagcttaccaaccaaaaaaagtccaggatcagacggattcacagcaaggacttcatgtctaaaacaccaaaagcaatggcaacaaaagccaaaattgacaaatgggatcttattaaactaaagagcttctgcacagcaaaagaaactaccgtcggagtgaacaggcaacctacagaatgggagaaaatttttgcattctacttatctgacaaagggctaatatccagaatctacaatgaactcaaacaaatttacaagaaaaaaacaaccccatcaaaaagtgggcgaaggatatgaacagacacttctcaaaagaagacatttatgcagccaacagacacatgaaaaaatgctcatcatcactggccatcagagaaatgcaaatcaaaaccacaatgagataccatctcacaccagttagaatggcaatcattaaaaattcaggaaacaacaggtgctgaagagggtgtggagaaataggaacacttttacactgttggtgggactgtaaactagttcaaccattgtggaagtcagtgtggtgattcctcagggttctagaactaggaataccatttgacccagccatcccattactgggtatatacccaaagaactttgaaacatgctgctataaagacacatgcacatgtctgtttatagtggcactattcacaatagcaaagacttggaaccaacccaaatgtccaataatgatagattggattaagaaaatgtgtcacatatacaccatggaatactatgcagccataaaaaatgatgagttcctgtcctttgtagggacatggatgaagctggaaaccatcattctcagcaagctatcacaaggaaaaaaaaccaaacaccgcatgttctcactcataggtgggaatagaacaatgagaacacatggatacaggaaggggaacatcacacactggggcctgttgtggggtgggggcagtggggagggatagcattaggagatatacctaatgttaaatgatgagttaatgggtgcagcacactaacatgacacatgtatacatatgtaacaaacctgcacattgtgtacatgtaccctaaaacttcaagaataaaaaaaaaagagtttttcaggatgatggtccatcctgaagtacataggaaaaaaaaaaaaaaggaaaccactatggtattccaagttcatacaatgtagaatagaagctggagtgttagtacagaaagcattatctgttcgatagcccggataaacaacttcaggaaagtttcaggatgcaaaatcaatgtgcaagaatcactagcagtcctatataccaacaaaatccaagtcaagagccaaatcaggaacacaatcccattcacaactgccacaaaaaataaaataaaatgtctagaaatacagtttaccagggatgtaaaatatctttacaaggatcactacaaaccactgctcaagaaatcagagatgatacaaacaaatggaaaaaaaatccatgctcatgggtaggaagaatcagtatcattaaaatggttatactgcccaaagcaatttgtagatttcatgctattcttatcaaactgtcaatgacatttttcaaagaattagaaaaatgtattttaaaattcatatggaaccaaaaataaaaagcccaaatagccaaggcaattgtaagcaaaaagaatgaagctggaggtatcatattacctgatttcaaactatgctacagggccacagtaaccaaaacagcatgatactagtataaaaacagatacgtggatcaatgggacagaatagagaactcagaaataaggtcgcatacctacaactgtctgatctttaacaaagctgacaaaaaaaatggggaaaggacaccctatttaataaatggtgttgggataactggctagccctacgcagaagattgaaactggaccccttccttacacaatatacaaaaattaactcaagatggactaaagacttaaatgtaaaactcaacactataaaaaccgtggaagacaacctaggcaataccattttgtgcataggaacttgtaaagatttcatgataaaaacaccaaaagcaactgcaacaaaagaaaataaaaatgacaaacagtatctaagtaaacttaagagtttctgcatagcaaaataaaatattaacagagtaaacaaacatactaaagaatgggagaaaatttttgcaaactatgcatctgacaaaggtctaatatctagcatctacaaggaactaaaacacattttcaagaaaaaaaacattaaaaagtgagcaaaggtcatgaacagacacttttcaaaggaagtcatacatgcaaccaacaatcacatgaaaaaaagctcaacataactgatcattagatgtagatgatgggttgatgggtgcagcaaaccatcacagcacgtatatacctacgtaacaaaccggcatgttcttcacatgtgtcccagaacttgaagtataataaaaaagttaattaattaaaaaaagaaaaatgtaaatcaaaaccacaatgagataccatctcacaccagagtggctgttcttaaaaagtcaaaaaattaccgatgttgatgaagtcgtggaggaaaggaaacacttgtacactctaagagtgtaaattagttcaatcaagaccagactaaatatagatatgcatccagaaatgcttttagaaaatatatcatatgtttataatacataagctaataaaatgggagagttctctgattcccctggcaggatgtgtgacaggggtgtggctcacctgtttggtcacccggcagctcaaacccctaaggcagatgggcaggtgcagaggccaggcaggtgcagaggccagggcagagcgttttggactctcagccccatggcagcgtctagggctgggtgcctacaaccacagtgttactaagctctgtcagctttgccatctgcaggcggcttgtgtgttagttagcccaataaaccctctgccttatctcaagggcagaaggccagtgtgacagtcttatgtatcctgagttcttgcccagtgtcccaaaagaatcggatcacacgtgagcgtgaaggattgaatgcaaggttttgttgttgttgttgttgttttctttcgttttgtttttgttttttagagacggagcctcactctgtagcccaagctggagtgcagtggcgccgtcttggctcactgcaaccttcacctctggggctcaagagtgaatgcaaggttttattgagtggtgcaggtggctctcagcgagatggataggtagcagaaggagggatagactgggaaggtggtcttcccctgcagtcgggctgcccagaggcaggactctgctctgaccgccgccagctccccaccaccccacctctccgctgaactatcctaagcatctagagaggtccctcctcttctctatttctctgccacatcgttctgccgttgctagtctgcttgtcggctggtcgtctggccttgatgttcagctgcttgtgtgtgtgcctgctaaggtctcaggtttatgtgggcacagaatggggggcgtggtaagccagagaggtcttggaaaatgcaacattcaggctcaaaaacaggagtgcctgttctcaattaggtctgtgggcacatgcccgagggtgaatccctcaccagtgaccttgctcttctctaccccacacttcgctgcccaatctccagttccactaatatatctaaaagtcacatgggatccctccagtctagattattggtgagactactgaaagcttcaggtacaactttaacatctgcttaccttgtttttttttctcttaaacagctttagtaatgtataattgatgtactataaattctacctatttaaagtgtacagttgataagttttgacatgtaaacattcatgaaaccattactacaatcaagataataatagatcaattgccgcaacagttttatcatgttcctttgtaattgtcttatacttctccccagtctcctatagccaggtaaccattcatctgttttctgttaatagagctttgcttgcatgttatagagtttcatataaatggaaccacagtctgtatacttgtttcactagcatctttcactcagcatcattatttttattttgagatttatttactcttcatgtaccaatggttcattccttcatagtgcggagaaatacctcattgtatagatatgctacaatttttttattcattctctgttgatggacatttaaattgtttccaatttgaggtcattgcaaataaaattacgatgaacatttgtgtaaaatctttaaatggatatgtgttttcatttctcttggctaaatacctagaagtaaattggctagatcacagggtaagtggatgtttaactttttaggaaactatcaaactgttttccaaactgattttaccattttatttccaccagcagcgatggagagttctggttgctttatattcttgccaacatttgatatgacctgtctctttaatttcagcctttctaatatgtgcatagtacttcattctggttttagattgcctttccctaataactaataataataagcatcttttcatgtatttactgaccatctgtatcttctttggtgacatgtcttatccaacattttaattactttgttttattatttatcgagttttaagagttatttatatgtgttctatgtatcttttagcagatatatgttttgtaaaatattttttatttcaatagctttcggggtacaagtggtttttggttatatgtattaattgtatattagttaattctgagattttattgcaaccatcacccaagtagtgcatgttgaacccaataggtagtatttatcccacaccccattcctaccctctcctttctgagtctctaaagcccattatattactttatatacctttccgtactcacagcttagctctcacttacaagcgagaacatacgttgtttggctttccattcctgagtgatttcacttggaataatggcctccagctccatttaagttgccgcaaaagacattattttgttccttctcatggctgagtagtatttaatgatttatatatacacctcattttatttatctactctttggtcagtgtagacttaggttagttccatatctttacaattgttaattggattgcaataaacatatgtgtgcatgttttttttttcttcatataatgactctttttttggtggggggatagatacacagtaatggcattgctgtattgaatggtagatctacttttcatttctttttttttgagatggagttttgttcttattgcccaggctgaggtgcagtggcgtgatctcggatcactgcaacctccgcctcccagattcaaaagattctcctgcctcagcctcccaagtagctgggattgtaggtgcccacctccatgctcagctaattttttgtactctttttagtagagatagagtttcactatgttaaccaggctggtctcaaacgcctgagctcgtgatccacttgcctcagcctcccaatgttctgggattacaggtgtgagccaccgtgcctggcctcaacagtgttttatagttctccttgtacggacattttatcttcctggttaagtatgttcttaggtattatatttttttgcagttaaaaaagtgatggaatttttaaatttgattctcagcttggatgttattgctgtataactgtgctactgatttgtgtatattgattttgtaacctgagatgtaactaaatttgtttatcaaatctaggagtcttttgaagaaatctttagagttttctaggtatacaatcatatcataagtgaacagtgatagtttgacttcatctttttcaacttggatgtctttcatttcttttttttcccctgattgctctgactaggacttccagttctatattgaatagaagtgataaaagtgggcatccttgtcttgttccagttctcagagggaatttcagcatttccccattgagtataatgttggctgtgagtttgtcctatatggcttttattactttgaggtaagtcccttctatgcctaatttgttgaaggtatttattataaagcattgctgcatattatcaaatactttttctgcatccattgagatgattatgtggcttttgtttttaaatctgtttatgtgatgtattccatttattgacttgcatatgttaaaacatccctgtatccctgggatgaaactcacttgaccaggatgtattatctttttgaggtgctattggagtcagttagctagtattttgttgagaatttttgcatctctgttcatcagggatattagtctgtagatttttttgttttttgttatgtcatttattagtctgtagttttgttgttgttgttatatcattttctagatactggcttcacagaatgatttaggaagaattccctctttctttatttttgggaatcatttcagtgggaataattgatactaattattctctgagtgtgtggtataattcagctctgaattcttctggacctgtatattttgttgttggtggtaatttctttaatttctaattcaatcccactgttactggtctgttcagggtttctacttcttcctgatttaatctagaagggttttatgcttccaggaatttatctatttcctctaaattttttagttgtgtgtgtaacagtgatcatagtagccttgaataattttttggatttctctggtattggttgtaatacctcctgcttcattcctaattaagcttgtttggatattctctcttattttcttggttaatctcactaatggtctattaattttgtttatcttttcaaaaaaccagctttttatttcatttcacttaccttttgtattttttgttgtaatttcatttagttctgctctgatccttcctatttctttctttctgatggctttgggtttagtttgttcttgtttctagtgtttcttgagttgtgacaatatagattgtcaatttgtgctctttcagcctttttgatgtaggcatttaatgctatgaaccttagtcttagcactacttttgctgtttcccagaaattttgatcactctgtcactattatcattcattttaaataatttattaatttccatcttgatttttacccaaaaatcattgaagagcaaattacttagttttcatgtatttatatagctttgagggttctttttggagttgatttccagttttacttcactatggtctaagaagatacttgatatgattttgattttcctgattttacagagaacaattttactgatttatttatcagatctaacaatttttaaatgaaatccttgggtttttctagatattatactatgtcaaatgcaatgaagaataacttgacttatttatttccaatttgaatgcactttattttattattattattttttgctcctaattgcactaacaacatcttctggtattatgttatataagaggactgacagtgggcatctttctcttgttccagtccctaggaaacattctttaatttttttcttgttcagtatgattttagtcatggatcatatatggcctttatcattttggagaatgtttcctctaaagtcattttgatggtttggtgatctaaaaccattataatttattatatagggatttggatttttatgggctttttttagcatgtactgaaataatcctataattcttggatctgttaatacggtgggtcatgtttactgatttgcatgtattgaaacatccttccctcctcccttgcacgaattctgtgttaccctagaaaattatcttcttaatgtattattagtttggtttgcttgtattttttgaggacttttgcatctacacttgtattagtccattttgacactgctaataaagacatacctgagactgggaagaaaaagcggtttaattggacttagagttccacatggctggggaggcctcagaatcataacggaaggtgaaaggcatttcttacatagtggcggcaagagaaaatgatgaagacgtacgagcggaaatctctgataaaatcatcagagctcatgagacttattcaataccacaggaatggtatgggtgaaactgccccgtgattcaaattaactctcaccacgtccctcccacaaaaatgtggaacttttgggagtacaattcaagacgagatttgggtggggacacagagccaaaccgtataattctacccctggcccctccaaatctcatgtcctcacatttcaaaacctatcatgccttccccaatattcctcaaagtcttaaatcatttcagcattaacccaaaagtccacagttcaaagtcttatctgaggcaagacaagtcccttccacatatgagcctgtaaaatcaaaagcaagctagttacttcctagatacaatggggttactgatattgggtaaatatagccattccaaatgggagaaattggccaaaataaaggggttacaggacccattcaagtccaaaatccaccagggcagtaaaaatttaaagttccaaaatgatatcctttgactccaggtctcatatccaggtcatgctgatgcaagaggaggattccaatggtcttgggcagttcagtccctgtggccttgcagggtacagcctccaccctggctgctttcatgggctggcaatgagtgtctatggcttttccagttgcatggtccaagatgtttgtgcatgtatcattctggggtctggaggatggtggccttcttcttgctgctccaataagcagtgccctggtggggactctctgtgggggctcacagcacacattttcctttcacactgccttagcagagtttttccatgatggtctcacccctgtagcaaacttctgcctggacattcaggagtttccgtacatcttctaaaatcaaggtggaggttcccaaaccccaatttttgacatccatgtactgcaggctccataccatgtggaagctgccaaggtttgaggcttccaccctctgaagccatggtctgagttctacattggcccatttcagccacggctggagtggctgagatgaaaggcaccaagtctctagactgcacacagcatgtggaccctgagccctgcctaggaaaccatttttttctcctagacctctgggtctgtgatgggagaggctgctgcaaaggtctctgacattcctggaagacattttccccattgtcttgaggattaacattcagcttttcattactaatgcaaatacatgcagccagtttgaatttctcctcagaaaataagattttcttttctattgcattattaggctgcaaattttccaaacttttatgctctgctttcctttcaaaaaggaatgcatttaacagcacccaagtcacctcttgaatgctttgctgcttagaaatttcttctgtcagataccctaaatcatctctctcaagttcaaagtttcacaaatctctagcccggggcaaaatgccacccgtctctttactaaaacataacaagaatcacctctgctctagttcctaacaagttcctcatctctatctaagacaacctgagcctggatttcattgtccataccatttccaatacttttgtcaaagtcattcaacaagtctctatgaaattccaaactttctctcatttttctgtcttcttctgagccctccaaactgttccaatctttgcctattacccagttccaaagtcgcttctacatttttgggtatcttttcagcaatgccccaccctactagtaccaatttactctatttttctgttttcacactgttgataaagacaaaccagatactgtgaagaaaaagaggcttggccaggcgtggtgactcacacctgtaatcccagcactttgggaggccaagacgtgcagatcatgaggtcaggagattgaaaccatcctggctaacacggtgaaaccccatctctactcaaaatacaaaaaattagccagacgccttggtgggcacctgtagtcccagctactcgggaggctgaggcaggagaatgccatgaacccggggggcagagtttgcagtgagccgtgatcgcgccactgcactccaacctgggggacagagcgagactctgtctcaaaaaaaaaaaaaaaagaaaagaaagaaaaggaggcttaattagacttaaagttcctcatggctggggaggcctcagaatcagagcaggaggtgaatggcacttcttacatggtagcagcaacagaaaatgtggaagatgcaaaagtggaaaccccagataaaaccatcagatctcatgagactcattcactataatgagaacagtatggaagaaacagtccccgtgattcaaattaactcccatagggtccctcacacaacacatggaaattatgggagtacaattcaagatgatatttgggtggggacacagagccaaaccatatcaatactcatcagtgatactggcttgtagttttattgttttgttatgcccatgctttgtttttgtgtaagagtaacattatcctcatagaatgagtttgaattattcccttttttttttatttctctttttcttttcttttttttttttgaaaaggttgagtcagattggtatcaagctgttacatgttgggtataattcaaaagtgggatcataagtttctgaacctttttattttgatgaaagacattttattacttcaataacagcttcaatcccttgcccattattatttgtttgatgttttcaaccgctttatagttcaatcttagtaagttttgagtccagaaattcatatatttcttctaggtttactattaatttatcataacaattctaatagttttgtattattttggtctcagtttttatgtctcttctttttccatttctgatggtttttatttgcatcttgtctatgtttttcttgcttaacttagctaaaggtttgttaacatcattgatctttgaaacaagtcagggtcactggtctggttgtctaaggtgttatcagagcttgtgatctcaggaccaaaaaaattaagaagcgtggttacaaagggtgaggttggagcaaaaatttaataacaaaaaaacaaagctctcggcagtggagagggttccctgatggttgctgtgttacggttgtattcaaaagctcttatgaggaactgctttcatctctgtaactgagtaacttttcttatctataaaactgcctgcatagtttcatctctgtaactgagtaacttttcttatctataaaaccgcctgcatatctcccagttattctctgtcattgtggatatgtctccaggaaagcacaaagtgctgtttcttgcgtttgtataatgatgggtttgttttaggtacacccccctcctctctttgcaaattcccatggagcccactgtgtacatgtctgaaaaggggaggacactttttcctgggagcttactaatcatacaaagagcaaagggtttctatgctggacattgcatgccttgcctgcttatctgtggcttatctgtgcaggtgcactgtagctgtgattttttttttaggcaggcagcttctgcagtctgagtttttccccaagctgctctatttttcctgtagttgtgagttttcaggaaggcagcatttttgaggaccagccttaattgtttacttaactgattttctcttttcttctccatcatcttcacaaaaaaacaactttttgtttcatagatcttttgtattgtgtttattttagcctcaaatttatttaactgtgttctggtctttataatttctttctttctattagctttgggtttggtttgttcctgcttttttagttctttgatgtataggattaggttatttgaagtctttcaacttttttgatacagatgtttgttacaagaaactttcttcttacagtttttttggccatcttccatagatgttggtatgctgtacttccattttcatttgtctcacaaaatttttaaattttcttcttaataacttcattgacatgtttgtcatttagcagtatgtttaatttccatgtgttcatgtctgttttccagattcttcttttaatttattttttgttttatttcattgtggtcagaaaatatacttcatatgatacttgtgtttttgaatttgtacaggcttgtttggtagcctatcatagaattaagggagacattttttgtgctaataaaaagaatgtctattctacagcaattatgtgaaactttctgtatatgtcagttaggcccttcatatctagtgtgtactttaactctgatgtttctgtgttgattttcttcctggataatctttccattacagagaatggggtgttaaagtctcctactattgctgtgttgcatgctagttttgcctttaggtctgttaatgtttgctttacatgcttgagagctcaggttttggtaagtataatgactaaatcttgctaaactgaccccttcattatcatgtagttactgtctttgttttttgttttttttttcccgtctgatttgtaatctgtttataactacacctgtacttttctggtttctagttgcatggaatatattttgccatcccttcactttcagtctatgtatggctttataagtgaagtgggtttctttaaggcagcatgattctttattcagccattctatgtcttttaactgagaactgagacaatttacatccatttttattattgacaagtaaggcttactagagccattttgttgattgtttactgtttgtttttagactcctctcttccttccttcctgtctttcttcataattaggtgattgtctctggtagtatatttcaagttgctgctttttaagtacatcaatgatagatttcttaactgtggttaccagtagacttacagaaaaccattttagagatatggcatgttattttaaagagatcacaacttagattgcaaataaaattataaaataaataagggcaaaagtcacagaaaatgtatatactttaactcaatcacctacccattttgactcatagttatcttgatttacatatttgtatatcatctgtttcttaaccggttgctatagttgttatgttttctgggataggtgaaatgcagaacacaaattcagtactagcttattctgggtttttgcatgtactcaattttaccacttgtttttataccttgaaaagttactttttgcatgatagtgttttactctttctgactgaagagctcccattagcattttttgcaagatgggtctggtggtggagtctcaggacttttccttagttcagctaaagatgggatccttgtctgtcccatggccacaaaaatttaggctcacagatggtttgaatgtcgaggactctgaaaggccagagtccccctgctagagtgcttcctgctcaaagcttgaatcccagcttccacacagaaagaggaggggcctggctcttccccactgcaaatggcacaaacttgctgaggttccaccccagtgaacatttttctcagtgttcaagctctttggagattctctggggaccacctcctacctggctgtctctttcccccttgtaaagaagtacatctgaatgctatttgaaagagcataaggaagatcaatctttactgcttcctgctgacaaggggtgctgtttttgggaaatggtggtcagagctcactcacaggcctatctaagagttcccccagcagaaagggccattgtcagagactctgcttgcattattgtttggagtttgatgccctgaaggcaagaacagacaaactaggttattagaaaacatgtatcaaaatgaaacaaggggaggagtaaggatagctcaaaaattctgaggccttttatcactttgcacagggagagaaaggccaaaagccagactggtaaaatacccttttgctggcatgttggtcttctgggttcccttcttctgggcccaatctttagccaaccagcttaaggtttggaaagttaactctttccagtttggaagatgcatctgaggggaatgtcccagaatacggagacataattacctatccgtgaagagagaacagaggagaagaaaggaaaaagaaggcaccttttaaagaagtcccagggggtcatgatgcattcaaaatgggtacagactgaaggtgaatggctactcacctaggaagagggtggcaggtgtccctagttctcttctctttctagcagatacctggggtacatgagggagaaagagcatcctcttttcttcttccgtccttgcttccccgagtgctggtaaccttggtatgtgctgaaacaggtgtcaaagcaacatgcacccatgaaccagtggggcctagggggtgagaacattcactcttacccacttacccacatacaccctatctcccctgctttcagtagtctgggagtccctagacctcatctatgccatggatactaacaaggcttttatccatgaaccagggagcttgggcttcacttaattggcaggaaacagccacactcacctgcactgtgcattttgttgcacaaagtaggggcttatcctgccttagggactgactctttttcaggtttgatatctgcatgttttccttggcctggctcttataaaaccccacccaggaactgggttttctcctgcctgtctgcgtgtgtgttatgtgtaatgtctgcagaaagagctctaaatgattttggcctgaaaaagacaaacacttgcatctaatattttttaaagagaagttaaaaactgtggtaccgttcagttcacgtgactttaatctttgagaaataggaagaggcttaaagattaatggtaaaaagcagatgtcattacagtgtaaataggtggactaaataacgcaatggtgtctttgtccatctcagggccatgaaaatttaggctggcagatggttcaacaggtgagtaaagcagggttttattgggtgaaaaggaaaaaaaaaggggaaacagggatcttccacaaggctggagacccctgccagagtgcttcccactagcagcttgaatcccaggttccacatgggatatttgccgggctcctccctgttgcaaacagtgcaaaattcctgaggttccaccccagtgcacattcctcccagtgcacaggcttgttggagattctctggggacctccttctcctctgactagctcagtggtcaattctatgttttgtttgcctggtaaatacttcatctctcatttatatttgattgataattatttttgtttcaatattttttggtggcatccttttgtgttgagcactttgaaaacatcattccagtccttcctggtctgtatagtttcttttgggaagtctatctccataaatattggcgctgttttatatgttatttgctttcacttgctgatttcaatcttttttctttaatgtatttttttttgtcctttgtgactttgattattttgttaattggggtagtcttatttgggtttgcattgtgttctaagacctttctgtacctggacattttatgtttctcaagttttgaaaagttttttgttactatttttttgaatgagcgttctacccttgctcttactcacatctctcttgaacaccaataattcttagactgggtcttttgaagtaattttctatattttgtaggtggcacttgcttttttattctctcttgactttttaaaaataaaataacgagtcttagagctcacagattcttttctgggcttggatcattctgtggtttaagacctctaatggattttgaattcagcaaatgcatttcttagttccaagatttctgattgatttctttgtattattttaacctttttgttaaatttctcggataaatttctgaaataacttcctgtgttaacttagacattactaagttttcttaaaactgctattttgtattctgggtcagagagctcagaaattgggttatcttattagtgtcaatcactagatttttgcattgtccttttggagaggtcctggttccctgttctctgttgtttcttgtgaatatatgcatgcctttgcattgaaggattatttgttccattttttttctgtctttttttaatggaatatatttgcttagaaaatctttaccgaaaagtcactgcattcactttagttctaggtgacatgttaagcccaggtttacctcagctcatgtgaatgattagagctctgcctgtcccaagtgatgggggttccaaatggattatcctggaagtgtgagaacactgcctaagggcttgttcccagtatacctaaagaacttacatcctacagcatgctgttgctaagcaactactctgatttgaggtcaatttttggctgagttacggagaagagtttccatgtctaagaggttggtagtcctgcctctcttttttgtctctgcctgtcctcaggaatgtttctcccttcatgcactcataacatttccactgggttaaggaaagacaggtctaccagggaacttgataagatggggaagcttagtgaccatatcagtttgtctttctctcatttatataaaaattacttgacattgagtaatttataaagtaaagaggcttaattgcctcacattctgtatgctatacaggaagcatagtggcttctacctctcaggaggcctcaggaagcttgcaatcatagtggaaggcaaaagggcagtcaacacctcatatggccagagcaagaggaagggagttgtaggaggtgctacacacttttaaacaaacagatctcttgagaatgctgttacaagaacagcaccaaagggatagtgctgaatcattcatgaaagatccacctgatgatccaatcacctcccagaaaacccatctccaacactggtgattacaactgaaaatgagatttgggtggggacacagatccaaatcatattgtaaatcatgaattggagatagatattctgcgtttttggtgcagagcagagttgcaagttaggggcattattaatgtagacatagacatataattcccctacgtagtgtctactcagactttttctacttttatgacactgggaaatgtgttatcctcttaattaagcttttggttgttgtggtgtagatctcagtgccatatgtttgttttgttttgttttgcatgaagaaaaaaaggctgcttgtctctactctgccattttggaaccagaagtctcttgctccgtatattcttaataaacgtttcttatcagatatatgaattagaactttttaaattctacttatcatcagtacacttttttgatggtgtcctttcaagaacaaacatattcatttataagaatatcagtttatccattttaacttagttttttgtgactttgttgccttgtcctagaaaccattgccaaattgaagatagaaaagatttactttttctattctgggttttgtacttctgtttgttaactttgggttgttgatgtattttaaattagttctttatgtgttgtcagagaaagtgtatcttgtttttttggcctttggataatcagtctcccagaagtatttgtggaaaatattgttgttttcctattcaatagtttgacgtctttctcaaaaattaagtcaccactgtgtaaaaggatttctggattctaaaatctgttccatttatttatatggtgatctgtgttcctgtgtcacactcttataactattgatgatatgttgttggttgaaaatcggaaatgcaaggactaaattatttttcaaaatattactggttattgagattgtgccactgcactccagcctggccacagagcaagactctgtctcaaaaaaattatacatatatatatatatatatatatatatatatatatattgtgtgtgtgtatatatatatagtgtgtatatatatagtgtgtatatatatagtatatatacacacacacacgtatgtgtatgtgtgtatatatatatatatatctcgctattttttggtctcctgtatatctatattaatttagaatgagcatgtttatttctgtaaagaacccagctgggaatttaatatggattttggttaatttgtttattaattaagattttcaattgaggaatatgagattttatttattcattaagaattttattcctcaatatttagtaacttttacaatttaagttttaagtttcgcaatttattttatttttttgagatggagtctcattctgtcacccaggttggagtataatggtgccatctcagctcactacaacctccacctcccaggttcaagtgattctcctgcttcagcctcccaagtagctgggattacaggctcacgccaccacgcctggctaattttttatatctttagtagagctggggcttcaccatgttggccaggctggtctcgaacttctgacctcatggtctgcccgcctcggcctcccaaagtgctgggactacaggcatgagccactgcacctggcctaagttttgcaattcttttaatgtttttcctgtttttttaaaataatttttgattatattttatgtaggatttttgaacatgttattttcttctgtattgttcaattatgtaacaatacaattaatatttgaaggttgaccgttagtcctaaaaatgtgcttattttgttgttgatctaatattttctaggaaagtctaagatattctttacataaggtcatgccttttgtcaacaaagagagtgtacttatttcttaccttctaataaggattatttttgttttgtgttacttcctatttgctttggctggaatctccaatataatgttgaatagaagtaataagaatgaatgtctagtcttttccttattttagaaaaaaatgagttaatcttcataataggtgtctccagacaaaaagagccatgtatgaatacacacacattagtacacacctatgagggaggattttattgtaggaatttgcttaggctgagaaatattatgatatacacttacacactttatatttaggaaagctgatgctgtaattcaatctgagactgaaggccttagaactaggagaaatagttgtgtaattatttgtctgaggatgatggccttagaacttaaggagctacaagtggggtttactagtgcaaaccctagtgtccaatggcccaatatccagaagcctcaaataaagaaggcagaataatattaatgtcccagccaaagaaaagagaaatatttgtcttcttctgccttttgctctatttgggttcttaacggattggatgatacctgcccacaatcatgagagatatctttagtcagtctactgatttaaatactaatctctttttaaagtattgtaacgtttgtcacagaatcataaaaatatctatcctaaaattcatacaaaccccaaaatagccaaataaatcataaactaaaagaagaaagccagaggcatcaaattacctaatttcaaaggatattaaaagcctgtagtaactaaaacagcatggtagtagtacaaaaacagagacatagagcaatggaacagaatagagaaccaaataataaagccacacacctactgccacctgatttttaatgaagtcaggaataacaagcaatgaagaaagaaccctctattcaataaatgatgctgtgataattgtatagtcatatgcagaagactgaaatttgacctcttcctttcaccacatacagatatcaactcaaggtgtattaaatacttaaatgtaaaatctaagactatataaatatgagaagaaaacctcagaaataccatcctggatacaagccctggccaaagttttatgacaattaccccaaaaggaaattgtaacaaaaaaaaaattgacaagtgagacctaattaaactaaagaacttgtgcacagaaaaacattcaataacataaacagataacctacagaataggagaaaacatttcaatactatgcatccaacaaaggactaatgtttagaatctagaaggaacttaaacaaattaacaagcaaaaaagaaaaatcccactaaagagtggccaaaagagaacagacacttctcaagaataagtacacatggccaacaagcatatgaaaaaatactcaacattactaatcatcagagaaaagaaaatcataaaaaccactataagataccatcccccctagtcagaatgaatatcattaaaaagcacaaaatgacaggtgttggcaagattagggagaaaagaggatgctcatacactgttcgtgggaatgtaaattagttcagccactgtagaaagcagtttgaagatttttcaaataacctaaaatagaattaccattttacccatcaatcgcattactgggtatatacccaaaggactgtaagttgttctaccagaaagacacatgcacacctacgtttatcaacagcatcacagtactattcataatagcaaaaacatggaatcaatctatatgcccaacaatggtggcctggataaagaaaatatggtacacatataaatgatggaatactatgcagcaatgaaaaaaaaacaaaatcatgtctcttgagcaacacagatgcagctggaattcattaccctaggcaaattaccaccagaaaggaaaaccaaataccacatattctcagttgtaagtgggaactaaacattgagtacctatggacaaagagaaaggaataataggcaatgggaaatatgtgaaagtgtagaatgagagatctatgagaatcaaaaaactacctaccaggtactgtattaactatcttggtgatgaaataatttttacacaaaaaccctgtgacatgaaatttactcatgaagaagttgacactttaaccttctgaacctaaagtaaaatttagaggaggaaaaatgaaatgctctcacagataaatccagaaataattttttttttttttagctatttggtaatctcttaaaccagtcaagttgacacataaaattaaccatcatagttg

SEQ ID NO: 95 - DNA, 744026 bp, Homo sapiens
  misc_feature (376196)..(476195): n is a, c, g, or t
tacatagtgtggtaaaatctgcaagagaaacttgcttaagattcattgtccaacggaaacaatctaattttgcttccttgaactataactgagttataagggaaagaaaaatctgaaaaaggtaactaagtaacttcgtgatatgaagacaaactggcaaactaactgcatattcagggaaagacaagtagtctagaagtctagaatgtggtacctctttttttttgagacgtggtctcactgtgacacaggctggagtgcagtggtgtgatcatggctcactgcaaccttgggctcaagtgatcctcccaccttaacctcccaggtagctggaactacaggcatgctccaccacatccgacacattttttgcattttttgtggagatataccatctccgcaagatggctaacacctagccatcttgcccaggctagtgtctaaatcctgggctccagcaatcctcccacctcggcctcccaaagtgcgggattacaggtgtgaagccaccaggagtggccccatttctaggaccttaattgaacactaatttgaatatacgaacacgcacacgccacaaacacacacacacacacacattaaataatatctgatgatcctgaggaattgctatttgtatttttagttttaataagttttgctttttaaagaatttcttataatttcatgattcatatgaaaatatttgcaggccagatgcagtggctcatacctgtaatcccagcacttcgggaggcccaggcgggcggatcacctgtggtcaggagtttgagaccagcctgaccaatatggtgaaaccccgtctctgctaaaaatacaaaaattagccaggcatgatggcatgcgcctgtagtcccagctactcgggaggctaaggcagaattgcttgaacccgggaggcggaggttgcagtgagctgagattgtgccactttcaccccaaccaggacaacagagctagactctgtctcaaaataataataagaatagtaataaatatttgcaaatgaaattatatggtatctgggatttatcaaactggtggcaggtgtagcgaaatgggtaggagaatagattaaacaagtctacccatgagttaacaattgttgaagctgggcgatacatatgtgaaaggaaaatctccccaacatcactaagccaaaggaagaagtcaagctggtgattgatgtctcatgtatccctaaaatgtataaaatgaagctgtgcacgaccaccttgggcacatgtcatcaggacagcttgaggctgtcatgggctctttcttaaccttggcaaaataaactttctaaattgattgagacctgcctcagataccttttgatttccacatacattagttaatattatactctcttctctacttttttgcatatttgagtttcctttaataattttttgtaaagaagagcataagaaaacagccaagtaatttagaagatatcaaaatgccattttccctgattctacatttgtcctattagaactaaggagtaatttttaatgtaaatagaattccatatttgcatctttgttattaaaataagtttatggggccagctgcagtggcacatgcctgtaattccagccctttgggaggccaaggcaggtggatcacttgggctcaggagttttaagaccagcttgggcaacctggcgaaaccacatctctgcagaaaataaaataaaaaatagctggtcatggtggtgcacacctgtagtcccaacttctctgggggccaaagtgggaggattgcttgagccggcgaggtcaaggctgcagtgagacatgattacgcctctgcactccagcctgggcaacagagctggaccctgtctcaaaaaataaaatgaagtaagtttatgttaaactaagagcacagctgtaaaaaaatgcggtttttaattcagtcatgttagtaaataggaaaagttgttgaggttataaaggatgaactctaggtatgttgaacattggtctgaagctattgtgtagtgattaagagagtaagctttgcagtcataatgacgtgggtacaaattccagctctgtctctcaatagcatgagaccttagagaaattaacttctaatctttagtatcttaataaatgggaatttagaaataatttccaaaggattgctataatgtttcaaatgatttttttaaaggcagttaagtgatcaataagctggagctattgttatttttattgtttctgtagttcaggaaagatggattgttctaacaattattgttggtgaacttaaccagaaaatgtagtattgagtgactcagatttttggcctagctatgggtggaaataactttctgggtaaagatgctgaactaaaaacttgcagccaaaaatcctcttcagacctcagggatcatcacaatataattgtaaaaatataacaatgaacatggaagtacagatatctcttttgagagcctgatttcaattgttttggatatatacacagaaatagaattgctggatcatatggtagttctatatttgaggaacttccatactcttttttttttttatatagtcgctgcaccgttttacattcctgctatggtgtataagtattccaatttctccgtatccttgccaaaacctggtatcttttgaaacaacttatacgtctgttgaaagatgaatgggttaaaaaacatatggtttatacattcaattgaatactattcagtcttaaaaaagaagaaaatcggccagtcacagtggcttatgcctgtaatctcggcactttgggaggccaaggcaagccgatcactagacgccaggagttggagatcagcttggcatacatggcgaaaccccatcactactaaaaatacaaaagttagcctggcatggtagctcgcacctgtaatcccagctactcaggaggctgacaggacaatcggttgagcctgggaggcagaggttgtagtgacccgagatcgcaccactgcactccagcctaggccgcagaggagagactgtgtctcaaataaaaataaaaataaaaataaaaaaaggaaatcttgctgtatgtaacaacatgaatgaccctggaggatgttctgctaagtgaaataaatcagtcggagaaggacaaatactgtactgcatgattccacttctatgaagtatctaaaatattcacattcacggaaacagtaagatggttgttgccagggactagggggaaagggaaatggggagttgctgttcaacaggtataaagttttatttctgcaagacaaataagttatagagagctgctgtacaatgttgtgcctgctgttaatgatactgtattctgcacttaacattttgttgagggtagatttcatgttcaaggttcttactgcaataaaattttttttaaaaaacctcaataattaccaaaaaattatttcaatatgtagtaaaaagaaatataatgcttctgaaggcagttccttttgtactgatgataacgaattgtgaattgagatgagtggaatttagcaataaaaagtgtcaagagcattgggcaatattgatgtcaattctacctaatttcatctatagatttggaacaatcccaatcaaaacctcagtgctttttaacagaaattcacaatattgagtttcttgttaattgaaatttacaaggaaaggtaatggatataggatatcgaaaacaattttggaaaacaacaacaattttggaggactagcattacctgatttcagggcttactacaaacttatggtatcaagatagtgtggtatttatgtaaagtaagacaaatacatcaatagatcagaacacagtgtccaaaagtagagtcacagatattatggtcaattgaatttgacaaaggtaccaacataattgaaatgtgtagaaggatagccttttcgacaaatagtgttgaggcaattagatatacatatggaaataaatgaccgtgacccctaccttacataatacacaaaaattaattcaaaatggatgataggtctaaatataaaagttgttttaaaacttctagaagaaaacatgggagaaaatttttaccaccttggagtaggaaaagatttctcatataaaataatcacaagtcctaacatttttaaaaattaatacaattgcagctcaaaaaattaaaatgttatggtctttaaaagatgctaaatgaataagtaagtgaataaggcacattacagactaggagaaaatagttacaaaacatttgtccaacaaaagactcgtaggatatatacagagagaggacttgctactcagtaaaaagacaaatatcccaatttgaaaaaatagacaaaagacttcatcatagaagatgtgttgaacaggcaattatcacatcattgtcatcatgaaatatcacttcaatcccactggaatggctaaaattaataagattggaaatagcaagtgtcgcacaggcatggtggctcacacctgtaatcctagcactttgggaggctgaggcgggaagattgtttgggcttggagtttgagaccagcctgggcaacatagtgagacatctctacaaaaaattttaaaaattagcagggcatggtagcacatgcctgtagtcccagctatttgggaggctgaagtgggaagaactcttgagcctggggaggagagggctgcagtgagccctgattacaccactgcactccatcctgggtgacagagtaagaccctgtgtcaataaataaataaatacataataaaaaatgaaaatagcaaatgttggcaaggatctgaagcaattagagcatttatactttgctagtaggaatataaaatagtacaaccactttggaaaacagtagtaattatttattatgaatctaaacaagtacttatcataggacccaatatttcccctcctaacaaaaacaaattgtgtcatatttatcagtcaaaatactgctcagcaataaaacaaaaactacacatgacaacatggatgaatctcacatatatgctgagtgaaagatgctggacacaatatggttgagatgacactagtcattaagaaataaatcacatttgtggttcccaggtgcaagaatgttggggaagtttaatggcaaaggagcatgagaaaccttctagggagatggaaatgctctatatcttgattgttgtggtggttacgtggatgaatacaaagactctctccttgaccaaacttagtcaggctcctctgataccttttgtcaactagaccttgaccttaggcttccatgtctttatttgttcagttttagctagactcctgctaagtcactttagtaagagtcccttgcttttggtatctggtcaccttcaaaatctgatcaaattcattattctctaccttcccccagatgatatctgatcaccctaacctgcctttagaaagaatactatcaaatcagtttagcaagaatctcctcttaccccttgctatgatttggatgtttgtcccctccaaaatcatgttgaaatttaattgccattgtaacagtattaagaagtgagacccttaagaggtgattaggcaataaaggctccaccctcataagtgggactgatattataaaaaggagacttcaaccctctgttggcctttttgccttccaccatggaatgatgctgcaagaaggctcttaccagatgtcagcaccttgacattgaacttctcagctttctgaactatgaaccaataaatttctgttcattataaatgacccagtctcttgggccaggcatggtggctcacgcctgtaatcccagcactttgggaggccaaggtgggtggatcacttgagatcaggagttcaagaccagccttatcaacatggagaaaccccgtctctactaaaaatacaaaattagccaagcgtggtggttcatgcctgtaatcccagctactcaggaggctgagacaggagaatcgcttgaacccgggaagcggagatttcagtgagccgagattgcgccattgcactccagcctgggcatacagagcaagactccgtctcaaaaaaaaataaataaataaataaataaataaataaattacccagtctcaggtattctgttacagcagcacaaaatggacaaagacacccctaatgtttcctcttagtaattttcaatccactgacccccaaccctgttcatttgctataaatctccccttgttcatgctgtattcagaattgagcccaattccatactgaggtttattttcctacattgcaatatttactaaataaaatttgttttttctgctctagctactattcaactgtgattttctttaacagtgtaatgcagcagagtcatttgtgttgtgccaagttcctgcctgtgaaatttagcatatgttgtagttttaaaataactaacattttaccaatacatttacttataacttctttttgacatatattatcttatttaacattctgaaacagcttgtgatttaattacaataacaccaattatatttttaattgaaaaataaataaaaggaatatttaaatatcactgggtattcttaaatttggaaatgtattaatcttcagatttaagaccaggtacctaagccttttcttccacagtaggatgtcaatgttaaattttcatttagcttttacatgtaccacagaatgcagccttgaatcctttaatagcaattatattggtttattgagtttcataacaggaaatagactatcaaaatataagtacttccaaaaaaagataacattttacaaggcccttttttggaaaacatggttaattattcctgagatatttatagaattctggaattctgaagttgttctgcttacttttgagtaatatcggtagctgacattttctgagtactgactgtgcccaatctgctctgtgtgctgcctatattttacctcacttaattcttatcacagtcttataagggattttttttttttttttgagacagagtatgccctatgtggcccaggctggagtgcagtggtgcgatcttggctcactgcaacctctgtttcctgggttcaagcgattctccttcctcagcctcccgagtagctaggactataggcaagcaccaccatgcctggctaatttttgtatttttagtaaagatgggtttttgccatgttggccaggctggtctcgaactcctgacctcaagtgatctgcccacctcagcctcccaaagtgctggaattacaggcatgagccacagcgcctgacttgttatctttattaggaacaaagtttcttctgagtaaacatttagtctttttgttgttgttgttgttgttgttgttgagacagggtctcgctctgttgtctaggctggagtgcagtggcatgatatcggctcactacaatctcctcctcctgggttcaagcattcttctgcctcatcctcccaagtagctgagattacaggtgcgcggcaccatgcctggctaattttttgttgttttagtagagatggggtttcactatgttggccaggctggtctcaaactcctggccttaagtgatccgcctacctcggcctcccaaggtggtgggattacagttgtgagccatcacgccggcttcttggtggcatcttgatacagggtgtgctggatatctgtggccaccctgatcaattttccaccttgctctattccttaagaatctcattcatagggactacacaataatcgtttatcttctctcagttttggttgagttcaggcatttgaagataggaagaaagtaagggttttgaactatttattttcatggctccctctatgtagggttaacatagggtagctctgtctctctatctatgacctcaattccttttcaaccctatctatacatctattctatctgggctctagtaactctgccttccacttgcccatccaggcccagggtagtgctatggaatgaactcccatccacccccaaattcatatgttgaagccctattccccaatatgactatattcgaaaataagaccttaaggaggttattaaacttaaatgagttcataagggtgtggtcctgatccagttgggttaatgtacttattaaaagagacaccagagagcttgctttctcttctcattcaggcaccaaggaagggccatgtgaggacaaagcagctgtctgtaagccaggaagggagccctcaccagatattgtaccctgttagaacgaaccttgatcttggactgtccagtctctaaaactgtaagaaaattaacttctgttgtttaagccatccagtctgtggtattttgttatggaagcccaggctgactaattgggatagtaaggcactatcttgtatagtttcttaacactctgcccgcacttttgtaaagagtccctttattaaactccccctaattggcattcatgctgttttctgataggatcctgattcatacaaagcagacaatcagagaacattacccaagctaagaagagtgactgacccaaatgttctccttctctcctggaacttgaaggcataataagagtgcatcttatttctcttggtagttaggcttcagtttctgtttctgttttgaagtgtatgagactgctgtaactcatgctctgttcttttggcccagccaatgtatggcagtttcttataaggatcacaacccaccatctcctcaggctgaccagattcttcacttcagctcttgctggtactgtggatttttcaagactcacttatgtgcatactccatttgaccctagcactggcctttgcagtggtgactccttggagaaaaactcactcagtccatggttaacttgcacacacctccagagttacatgggcatttctagttctcttcacatcttgggaaaccaagagacaatctcctaggctccccctgcttaaacatgctacttaaccattttaactctactgtggccttcacattggctctaggcactctgcttccaaaattccaaacaggaagtggggtgcaaatcctatgtactttcacttaatgtctctgtagacattcagaagcacatttccacccaatttccctctgaccctcttcttggacaaagtttttgtgataaccactttgatgataaagaatctagtgaggccttaagatacaacctaagaaagaaggtcaaaaactgcaaagtagaaagaacatttagatttctacaacttttgcaatttcttgtgtatgtgacgtttgtctccttataccacagagattaccaaaacaggcaccagaggaaaaaaaagatgatcaccaccaccaccaccaccatttaataaataatgtgtttagcataacttcaggatgagaaaagaagattagagctggtgggacagtgattctaagacttctcagaggtgatttccaggatgactactccaaagagaagaggcaagtaaactgcagtcctcaggacctgttgctaagaagaaaagaaattctgaagaatcaattcagatctgaaaatattggactgggtcgaaacacacttgaaaatataatctgtcatacattttctcattgcttaggagtatgggcttgggcataaataagattagcattttagcaaacatttactgcttagaagctatgtgaacgtggagaagtgtaacacagaggtgaagagccctggctccagagttagggatgtggcttgaatcctcgctctgctacccagagcaaattatttacttctttgagcaaattatttacttctttgaacctcattttgttttctttaactaggatagctaatccaatagttttttcttcatcaagtcatatgtgaagtacttatcactaacctgttgtgtgtatgcatgttagtgctaagtacttcagcaattgatcatcattattatcaacctgagaaaactcactttactcttgtcaaaggaaaataaatctcaggacccaaaaatcactaagccaaagggaagtcaagctgggaactgcaatgggcacacctgcctcccattctattcctaaataagatagctacaaaaattaaaaagctacatgcttcccttgcagttttcccataaggaaattccttgtgaacaagagacggaactcagagtcatccctgtgctcacgtgagtcagagtccagcctgggcagcatagtgaggccctgtctcgacaaaaatttaaaaacttagctgagtgtgattgtgtggttggctcatgcctgtagttccaattacttgggaggctgaggtgggaggattgcttgagccaggttgctcaatgctgcagtgaggtatgacactgccactgcatgtcagcctggaagacagagtcagatcctatctctggaaaaaaaaaatgcttgtagaatgtaaacatgaggccctgtctctacaaaaagttgcttgggtgtggttgagcccaggagtttgaggttgcagtgagcaatgattgcaccattgcattccagcctggataacagagtaagatactgtttgaaacaggaaaaagaaacaaaaacaacatttgtatgtgggtatgttttatttccggggggctgctataacaaagtattatagattgtgtcttcatattttggaaggggaaaacaagctcattggggccgcttttttaagggcactaatcccatttatgagggctcttctgtcacgatccaatcaccatccaaaggcccaacctcttaataccaacaccttggggcttagaatttcaacaaacggattttggaggcaggggacataaatgttctgatagcagggctttttagaagtgtcatgaataattaaattctaatcatggtagccaagccatgtatcagctttcttataacttaattagaatgccaaatactgtggaagaaacaataacattgcaagcaaatgtgttattgttactttgaaggaagttatcttctagtatagtagaagtagtagatattgtagtggggtaaaacgtgttttctgacaatgactccttttaccagtagtgaactggtaaatgtttaacaaccagctctccagaaaaacaaaataaaacaaaacttatttgtaatgtttgtcaatttatgtggtgtaattactcctgccatgaccaatttcaaactatctatgtgacatctcatcactgaacacaggaagaaatgagaagtaacaaaattttatagtattttcaccatacaggtgcaataattgtaaatataaataacctcaagaacaaataatattaagttataattgaaagaatcaggaagtggtgaattttgaatatttattacttttgtatttaatatagtttacttaactatacttaatattattaactttgtataatttattttttaataatccctatgtttaacaaccagtctacaaaaattttaaaaatttaacaactggctcttataagtcattacaggcaagcttcagcacaccattatgcttaactgcccctcagatacacagcactcatagctatatatgtatgattttataggatatcctggccacagctgatgagagtaaatagggatgggaataggttcaatgtcacttctcccagaatttggaaagggaatcagactggaaatcatcctgtttgtgtggctgaaactataactcatgaaaatttgaagttacaggcagtcactttttgaccattatgtggacttagtagtaaataagatttatcttccagtatagaagcataaaaatatgcaaagggaaaccagaaatggggaaacacatctcatttgtcttaaagcattctagatttcagcggcagttcttgagacctggttgcattctacccttcgatttggacagatacatttaccctcacagtagttttccttttcctctaatataactcgaattgctttttgttatttgcaaacaaaaagatggacatgaaggaaaaaggaaatagcaaaatacgcaaaataataagcgtagtataatactgggtgaaaaatgttcaattgctctatagctcatagatcaaaatagagaactttgccctaactctattcgtagataatgaacattaggataaatatttcaactctcctttttgagaaaaccacaatctaaatacagctacctttctctgtagattctactgtaatgtgtgcttggatttaactgcctctcattgtaaacaagattgttttgaggcagctgaaaggtaaagagctttcctttggcaagctcaacaactcttgtgacttaatcatcatctatacaagaatgattacttcagtcagacttctcacctgatgtcagttgtttccttgacatcttttcttagatgtctcatgattagctcaattttaaaaagctcaacagtacccccttgatccaccactacccacactgtccactaacctactcatgctagggatctgggaattagccttctcctcacctcacatctccagcacttgcagtacagtggggaagtgagggtgaaggggaaagggagctaaggtacagacaatggctaatttacatctcttggtggcaagtgttacaacaggaatagtatacaacactatagagacatacaatgggaataaatccatgagttagtcatatgctcctttctagaccgttctctgggtactcactgcctgaaaaacatgattttttcttacaggtttcagctaattctgcatctcaccaagaaatttttccttgacaacctctccctaacagaattagttgtctctgttgtgttcctgtaaccgagtatccccatttttcttaagaaaaagggaatgaataactattattattttctcttctctttttccttttccccttgatatggtttggctctgtgtccccacccaaatctcatctgaaattgtaatccttccccatgtgtcaaggaagggacctggccatggggcgataggatcatgggggcagtttccctcatggtgttctcaaaagatctgagttctcaaaagtgagaagtgagttctcaaaagatctgacagtttaaaggtgtgtggcagttcccccttcattctctcctgtcaccttgtgagaaggtgcttgcctctccttcaccctttaccatgattataagtttcctgaggcctcctcagccatgtggaactgtgaagcaattaaaccttttttaaataaatgagccagtctcgagtagttcttcatagcagtttaacaatggactaatacagagaattggtactggagtttgaggcactgctataaagatacttgaaaatgcagaagtgactttggaactggataatgggcagaggttggaacagtctggcgtgctcagaagaagacagaaagacatgggaacaagtttggaacttcttagagtctagttgagtgattttgaccaaaatgctgatattgatatggacaatgaagttcaggctgagatggtctcagatggagataaggaacttattgggaactggagtaaaggtcactcttgatatgctttactccagagactggcagcattttgcccctgccctggagatctgtggaactttgaacttgagagagatgatttaggttatctggaagaataaatttcctttttttttgagacagagtctcgctctgtcacccaggctggagtgcagtggcacgatctcggctcactgcaagctccgcctcccaggttcacaccattctcctgcctcagcctcccaagtagctgagactacaggcacccaccaccacacccagctacttttctgtatttgtttagtagagacggggtttcaccatgttggccaggatggtctcaatctcctgacctcgtgatctgcctgcctcagcctctgaaagtgctgggattactggcatgagccaccatgctcagcctataaatttctaagaagcaaagcattcaaagtgggatctggctttttctaaaagcctgcagtcatatgcattcacaaagagatgatctgaaattggaacttaggtttaaaagagaagtagagtgtaaaggtttggaaaagttgcagcctgaccatgtggtggaaaaggaaaacctgttttttggggagaaattcaagtcagctgcagaaatctgcaaaagtaaagagaagccaaatgttaatagccaagacaatggggaaaacctctccagggtgtttcaaagttcttcacagcagtccctcccatcacagactcagaggccaaggaggaaaaaatggtttcgtgggccaggcccagggcccccctgctttgtacagctttgggacatggttccctgtgtcccagctgctccagtgccagccatggccaatggaggacaaggtacagcttagttcattgcttcagagggtgcaatccccaagccttgatggcttccacatggtgttaagcctgcaggtgtgcagaagacaagagttgagctttgggaacctccaactagatttcagaggatgtatggaaacgcctggatgtccagggagaagtcagctgcaggggcagagccctcatgcagagctcatactagggcaatgcagaggagaactgtggggtggagcccccacacagaacctccactggggcaccacctcatgcagctgtgagaagaggactactgtcctccagattcccaaatggaagattcactgacagcttgcactgtgtgcctagaaaaactgcaggcactcaatgtcaggacttaatgccacccaatgaaagcaactgcagtggctgtaccctgcccagagccacaagggcagagctgcctaaggtcttgggagcccaccccttgcatcagcatgacctggacgtgaggcatggagtcaaaagagattattttggagctctaacacttaatgactgccctattgagtttctgatttgcacgggggcctgtagcccctttgttttggccaatttttcccgtttgaaatgggaccatttacccaatacctgtaaccccatcatacactggaagttattaacttgcttttgattttacaggctcataagcagaacggacttgccttgtctcagttgagattttggacctggacttttgggttaatgctagaatgagttaagactttggggtactgttggaaaggcatgattgtgttttgaaatgtgagaaggatatgagctttgggcggggctgggatggaatgatgtgatttggctttgcatcccaacccaactctcatcttgaattgtaatccctgcatgtcaagggagggacctggtgggaggtgattggatcataggggcagtttcccccattctgttctcatgatagtgactgagttctcaccagatctgatggtttaaaagtgtgtggcagttcccccttcatgctctctctcccgctaccttgtgaagaaggtgcttgcttctctttcaccttccaccatgattgtaagtttcctcagtcttccccagccatgcagaactgtgaatcagttaaaccttttttttaaaataagttacccagtctcaggtagttctttatagcagtgtgaaaatggactgatacacccctgttctccactttctacttagtcttttagtaatgacaatatagccttttaccatccccttcaccagacgctccctacagggtaagttcatctatgcactctaagacggaactctctttgagagttaacagtcgatttatagaccaaagcatgcctgctatggaactctcacccaccagagggttacctcaagagataacaattgaaaaacatgtccgctactgtctcccagctagggagtttttatcatagtcctgcccacaaaaatgccagaagtcaccagcttgacctcctggtatgtaagggaccaagctaacatgcagacccctcaccttgctcacttcctctcctgccttttaaaagtgcctgctttaggttctcactcataagtaggagttgaagaatgaaaacacatggacacagggaggggaacaacacacaccatggcctgttgggaagttggggatgaggggaaggaacttagaggatgggtccgtaggtgcagcaaaccaccatggcacacatatacctgtgtagcaaacctgcacgttctgtacatgtatcccagaacttaaagtaaaataaaaaaataaaaaaataaaaagaaaaaagaaaatgaaaaaacaaaaaaaggaaaaagaaagtaagtgcctgcttttgctccagaaacaaagtagtacatttaaagtcaagactcctgtgcttcttcccctaagctagcttgggaaataaatcactttgtttataccagacctcgcttttgttaattgggctctgcaagcattgagtgactaacctgcatttattagttacattctcactgcatttgtacttgtctccattacaacaattataattatagatacattttaagttactatggagccccagcagaatgcctgtcacatcaaaattatcaaagaagtatttagtaaagagaagaaaaaaaagaataaacagaagatatcaacagctctggattctaccagtgaccagcattcaatcaactctatataaattattctctctgttcctatattttctcctttgtccagtaagaaattggactcatggccagatgcagtggctcatgcctgtaatcccagcactttgggaggctcagtggggtggatcacttgagcccaggtgttctgagaccagcctgggcaaaatggggaaaccccattgtgggggttcagtcaggctggtgggaaaaattttagttatcatagccacaaaccctcttggaaggcctgagagtttgcataacttcagtaatagatctagctgaaggcagcctagtccctttacctttagttaaataggttaaagtagatacaaaggaatgtgggggagtttatctaactagcttgtttactcatgtggtcctaagactaatcttagtgtgcttaattgctttctactcgggaggtccgcaatgtcaattaccctctagtggtgttgactcaagcctttgtcaattaatctttactgaatgaatgtgagtcttgctgtgtctaggctggaggttccaactatttacagcactcttcttggtgtctgtaagtggtctggatgctcagccagactggcaaagcagaatatctgtgtcagtgcacgttattcatctgtcattgggtcagggtctgcaggacagacccctgcaccccatctctacaaaaaacaccccctgcaaaattgtctgggcatggtgccacatgcctgtagtcccagctacttgggagactgaagcgggaggattccctgagtccaggaggtggaggctgatataagccaggatcatatcattgcacttcagcctaggcaatagaatgagaccctgtctaaaaagaattaaaaaaaaaaaaaaaggaaagaaaggaaaaaaagaaaaacgatatggagcttgaactttccttgactttgggcacgtcacatggcttcgatttcttcatctataaaatgtcaaccacagagttattgtgaagatcaaatgagctgtgcatgtgaaatgaaactacctttacaagcattaaatgctataaaaattttaagcatggcttttagtagttttagctctaattttctattattctaaatagtggaatgtggtagaagtatatcactgttttttctttttttctttttaaccagtggtggggataaggggaaggaagtggttgaaaaatcgaaagggaacttcttacttgggtaagtctggacttaattgtgccaaactttctaaagcagcttccaggacaaatttccaggaatatttaaaaaattgtttagactgactggaacacagatatgaagccacattttttgtgcacgtgtgactatgtgtgcctctggaagatttcaacacaaacacgctctcatctaaattaacgctttcctctgaattgactcatttgaccagcataaccagtttgcatgccagtgcaagcagagaaagttgtaataaaaagaagaaaagaatgaaaggcatttagaaattcggtggttaaatgtacacttagttaatcattgtatttgtttttcaagggcttcctaaccttttggagaaagaaaaatatggcagaaagctgactgaagtttgaaattaatatgtgcaaaatgtctgtagaggatctagtctatcctcctttccttcatcttaagacttaattttatccaaaaattaagtagcctgattagtcatccttgctttcttctcttcctggctccttgggttttttcccacatgtatttgttcagcatctattacaaagcaggcactgcccaaggcattgtttttaatgtacaagtagggagtttgaaattcatcctttcgatcagaagttctcaaactatacggtgtatatgattcacaaggaaaatttgtccaaagtgcagatttctagtcttaatcccagatatcagatttgaggctcttcgtggggcctggcaatctgccattttaacaagtgtctgggagagctgtggctcatgcctattatgccagcactttggaaggacgatgcaagaggattgattggaatttgtgaccagcctaggcaacactgcatgactctgtctccacaaaaatttaaaaaattagccaggtgtggtgttgcatgactgtagtcccagctatttgggaggctgaggtgggaggatggagtgagctgtgatcgtgccactgcactccagcctgcgagacagaggtgagaccttgcctcaagagacaacaacagggccaaacgcggtggctcacgcctgcaatcccagcactttgggaggctgaggcaggcggatcacctgaagttgggagtttgagaccagcctgaccaacatggagaaaccccatctttactaaaaaatacaaaattagccaggcatggtggtgcgtgcctgtagtcccaggtgagacaggagaatcgcttgaacccgggaggtggaggttgcagtgagcgaagatggcaccactgcactccagcctgggcaacaagagagaaactctgtctcaaaaaaaaaaaaaaaagacaacaacaatggccgggttcagtggctcacgcgtgtaatcccagcactttgggaagccaaggagaatggattatctgaggtcaggagttcgagaccagcctggccaacatggtgaaaccctgtctctactaaaaatacaaaaattagtcaggcatggtggcagacacctataatcccagctattcagtagggtaaggcaggagaatggcctgaacccaggaggcatagtttgcagtgagccgagatcgcaccactgcactccagcctgggtaacagatggagattccatctcaaaaaaaaaaaaaaaaaagacaacaacaaacaagtgataagcaattcaagggactccattcacctgtttgaaattaataaaacacttagtgattagattaggttggtgggcagctgaactcttcaagattttatctatatctctttaagaactccagaatcggggctctctgttcgaatccagactctgccacttaggagctattcagttgattgtattaatcaagttaacctctttgtactctgtgtcctcctctgtgacagtacatgggaatcaaaatatctacctcagagagtcactgggcagatttagcagataaagcatgggtgttatctggcatatagcagtaagtacaaaaaagtagctacaataataataacataacatataaattaatataataacattgttaccattattggcagtagttttactgtggctctattttttagagagaagagagaagacacaaagttttgcccacaataagtggtcaggtcttggaatatgactagatgattgcttcaaaagagagaagtgttctgactgcttgtatatgtcttctgaggcggaaattgctgttagtaacaaccattttagtttacattttctaaatattattaaatccctgagtagtaggtaatattattgctattctgacattttcttctcatggcttaatttaaaagaatcaaaattatacccagctcagagaggtaaataacaaatgttctcaagaagcatctaaggccaggtgcagtggctcacgcctgtaatcccagcactttgggaggccgaggcaggtggatcacgaggtccggagttcaagaccagcctgaacaatacagtgaaaccgcgtctctactaaaaatacaaaaattatctgggcgtggtggtgggagcctataatcccagctactagggaggctgaggcagggaactccttgaaccctggacgtgcaggttgcagtgagctgagatcgtgccactgcactccagcctggacgacagagtgagactccgtctcaaaaaaaaaaaaaaaagcatctaaaacaggggtccccaacccccatgacacagattctggtccatggtctttaggaactgggttgcatagtaggaggtgaccagcaggcaagcaagtgagcattaccacctgagcaccacctcctgttggattagtggtggcattagattctcataggatcgtgaaccccattgcaaatcgtgcatgtgaaggagctacattgtaagctcctgatgagagtctaactaatgcctgatgatctgaggtggaatagtttcatctggaaaccattcatctctcttgtccatggaaaaattgttttccattaaactggtccctggtgccaaaaaggctggggactgctgatctaaaagatgtcctcatcataatcacagataatgaatacagaatactcagtatcggaggaaagataaaaagttcagtttgggtcaatttcttcactatttacatacacttagggccttagacccttccatgctaaaatttaaatgcatgcattagctcatttaatctataatagccctataagtaaattgctattataatccttatttatttatttatacatttttttgagatggagtctcgctctgttgcccaggctggagtgcagtggcataatcttggctcactgcaaccttcacttcccaggttcaagcgactctcctgcctcagcactccctgggactacaggtgtgcaccaccacaccacactaatttttaaaatattttttagtagagatggggtttcaccatgttggccaggttggccttgaactcctgaactcaggtgatcagcccaccttgacctcccagagtgctgggattacaggcgtgagccactgcgcctggcctataatctcattttaaaagatgccattataaaacatctttaaaaatgaaatttattctctgaagtgtcaacataataagaaagaaaaaaaagacacttaggttaactaaagtaataaaggaactcaaacttgaaccaagagctatgtgatcttacatctcactttagtctgcatatcaaaccgcctcctagacactttgaggctcacgggtctgaagtgggtgtagtggcatcctgggaagatttaataggacaacaaaggtaagtcacacaatgagctctaaattctagtctgtccaaagcatgctcctttctaaaattatattctaaaatgttaagaaaaaatacaaaaaagggcattttcagaaaatgttttatagtccttcctctgaatgactaactttaccttttttctacattgcatattctttatcccaaacatatgcagaacatgttgatgtgttctctgattacaaagtgttttcaaatgataatgtaatgactcagtagacttgtgaaatgcaggcagaaaaaaatcatttaaaaccaaaattgactgtgctgcttctacctgctaagggaagtggtctaattcgcatcagaggggtaagaggcagagttcccttccccttttgtaaaagaaaaatggggacagcaagcaaaaaatcactcaattgttaggaaaaaatatctaagccaccctctcaccttccttctctttcccaagaattggttgcactactgaaaccagaggagtgcaggaattccactattttgtaaaataagtttgagccaaatttgcctgaatttctaagacaggctactttggttgatacacggattaagcctaaaaataaaaccttttgagataaattgggtagtacacccacagaatcgcgcccgagtcaaggagggaaatccttttggtattgtgtttaaaaatcatttttaattttccctacaacgaagcgaaactcctcacatgtgtttaattgttcgctctgaaagactacacaggccgttacgaaaatagtttttggcatgagtagtgatctagttataaatcagtgaaaaataaattgtgtccataaaaaagttacagaatttacccctgtgccattaaatattagttaacaaccttgatttttaaattgatgtgccatattctaccatatcgatactgtatttgatatggttcagttgcagactgctcttccagaataaataggcagaaaggaatttatcactggctgcaaaccattagatggcttacaaactgtttggaattgtaggggcaggcgctgtgtgagcgtttaggaacaacttccattctccagaaatggcatgggtagtcctgcgatccaaaggcagcagtgtcaggtggaagcgctagaagcccgaggctgccattggcagaacaaagcagtctcggcctggcttggcagcatccaaaaggaccgcagccgccctgccgctgcacacggtgcatctgattggcggaacccaaacccttccgcagccctccctgcgaagatatctgggaaacgtagtttttaccttctaacctctaaggcacggaaagcttattcgatgttgattgtaatggaaatagaactatgtattaggatttgtttaaccatcccttgagttttaaattttttggttgttacgtaattttctctgtaataaataaataaaattccctaaacaatatgaatacttttcaaatttttgataatgattgcaaaattgctctcttgaaaagttatgccagtttatactccttccagcaatctttgttccatattgtcagtcatgattaatacatttgtcaatgcttttgaaaaggaaagtgacatattatttaaaaactatgaatttctttggctagtttgaagattttaattctcaccacaagtgaattacgattagatttttttttttttttttgagatggagtctcactctatcacccaggctggagtgcagtggccaatctctgctcaccagcaacctccgcctcccgggttcaagagattctcgtgcctcagcctccagagtagctgggatttgaggcatacgccaccacactaggctaatttttgtatttttagtagagatggggtttttgtcctattggccaggctggtctcgaactcccgacctcaggtgattctctggcctcggcctcccaaattgctgggattataggggttagccctcgcgcacggccgcaattaagtctttagacgatctgtttccccagtatttcccagcaatgtatttatgaatcatctcgcatctcgcatggtgagaaacttaacatgaacgttcaaccatgtaaaattattaccagtgaaataaataacttaatgtctagtgacctcttactgtagctctgtattggtagatagacacttcttttttgatctttcaagtatatagtaaaaaaaatgttccttttacagttttcaatttttttttttttttttttttttgagatggagtctcgatctgtctcccaggctggagcgcagtggcctgatctcggctcactgcaacatccgcctccccggttgaagcgattctcctgcctcggcttcccaaggagctgggattacaggcatgcatcaccacgcctggctaatttttgtattttctttaaattagagacagggtttcaccatgttggccaggctattctcgaactcctgacctcaagtgatctgcccgcctcagactcccagagtgctgggattacaggtgtgagccaccgcgcctggctaatttttcatgtttttagtagagacggggtttctccatgttggccaagctggtctcaaactactgacctcaagtgatccacccgccttggcctcccaaagtgctgggattacaggcgtaagccatcgcgccctgccttgttttcaaaattaaacttagttgaagcctgtaagacttaaaatgaaagcaagattatgtgacttgattatgatgcagccaaatgaatttagatgcaaatgctagacttgaaatgtaagtgtacgaatatacagcagtataattttatgaggtctgggggttacttgtgcatgagcccaggatttagatatctggctactcacagtaagatccatggaaggaaataaattctataaggaagcactgtataactcaaagaaactagagaggcccaaatgtccaaagctgccatttcgcttgctggaatttgctggtggaataactacccttccccgaattaatgaggctaaatgaattcctggggaaccctcaggctgtcagtgtaacacctcccacatcttttttctccagcaggtggcatgtacagcaccatcctgaaatggtgataactttattattattattgtcactattcatggggctaaccatcttcccttttcttcccaaataagtacatggagttttagcataggtattaaagaaggctcgtcagcatgatggcttaagtctgtaatcccagctactggggaggctgaggtgggaaccgaggagttcaaggctacagtgagctatgatcatgccactgcactatagcctgagtgacagaaggagaccccgtctgtaaaaacaatttaaagagagaaagagaaagatagagagagagagaattcttgtttcaatgacctagaggaaaaaagatgttataagttcgcttttgaaactggaacattaatttttcaccatattaagacaagaccctgtatatacacgttaaacttaaacagctatcttttaggctgttgaatgcaagaaggtaagtttaagtaccatctagtggtaggcatcaccctccacctagtggcatccctctccatctagtggcaagataggcgaattgaaagcaagtgccaaagaagaaatagtctgatactgaaatgttgaacaaaagtttaaaaagacaacagtattgaccacgcctcctccaagtcccagcgagcccgtgtacaacctgtcccgactccagccgcctcttcagctcgccatggatcccaactgctcctgtgccgccagtgactcctgcacctgcgccggctcctgcaagtgcaaagagtgcaaatgcacctcctgcaagaaaagctgctgctcctgctgtcctgtgggctgtgccaagtgtgcccagggctgcatctgcaaaggggcgtcggacaagtgcagctgctgtgcctgatgctgggacagccctgcccccagatgtaaataacgcgacctctacaaacctggattttttatgtacaaccctgaccctgacgtttgctacattcctttttctatgaaataatgtgaatgataataaaacagctttgacttgaaaaaaaaaaaaaaaagagaatagtattaaagtaccagataaactttaccactgttttattaaattttaatataaataaactatgtaaaataattcatgattgtagcaggttatctaatttggaaataaaaagaatactcttgctggatggtaaacagactattcctagcatgaggtcttttcttggaattattttatcttagtccttacctagaaggacttaggaagtgacaaacagtgctaaaaacctgagagaaaagttaagacatagtgacagaattttgcaggacaaaagagtgatattagtacagtctttcttatgttaaaccttttatgatcttgaaaatcttatctttaaatcttaagaagctgttggattatactttaatcattgcagggaaaagatttagaaattatgttgtcaaccagtttagatcaaattgacatcagaattgggtctttaggaggagatttttggtacaataactttgtaatctgaggatactaatcagggtataatagtacacttaattagtatgattagctgatagtctcaagttaggacgacagtcattgagcccatatcaggtagttaacagtgagcatctatctgttctaatatgttcagcattctgttaggattagttggtgtccatgctgtccttgttattaaatcatctgaatatcatccaagaccataagggactgtatgttcacaggaaaaaaataacaaaatcacaaaatgtgaagaatgtatgtattatgaaaagaaggtaggcaaacagatatctttaaaagaggaagctaaaaaaataaaaataaaagaggaagccaaatgaatggatcagatagaaaaaaatgttcaaaagtgtaataattgttttaaaaggactaaaaatatttttagagacccaaaggaggaaattagaaacatgaatcagaaaaatcagttatgaaggaccaactggagatattcagtatgaaaaacctaataactgaaataactcagtaagtatggtattagataaaccttatagatgttttttagatactgcttttcagagtgaacacacttgaaatacaaattagtgagctgaaagatcaggtcaatcaactcttctagaaggactcaggaaggacaaagcagtgctaaaaaactgagagaaaaggtaagatacagtgacagaattttgcaggacgaaagagtgatattagtacagtctttcttcagtatcttcaaggattggttcaaggacccactgccttcatagtaaaatccaggaatgctcaattcccttatataaaatggcctgtttgctcataatctacatacatcctcctgtatacattcaattatctctatattacatatgatacctaatacaataggaatgctatgtaaatagttgttatgctgctttggtttttatttgtatttttttaattgttaatttggttttttcttgaatattttcggtcccaggttgtttgaatctgtaaatgcagaacctgaagatacatagggctgagtgtatttgatagaaagaggacagagaaattgttgaaataagagaaatttgaagctaggatgctatatccaattaattcaatgtaaggctgaaataagttattgtaaggtacacaaggcctcagaaggctgacaaaaattctgtttgaaaacactttgggaggatgtgctcaagtaagacaaggaatcaatccagaagttaaccaagagatgtgaaaagtgtggaacaagtgaagctttgtaacgtgtttagatgaaaaactgccagaggcatctttaatataaacagcttcaggaagagagacacactgtattgctttctttatcccagagattttggagcgtatacataggtgtcatgcatgtcgtatgtatatgtgcgtatttgttggaggaacaaagcccaacccccacccccgacaaaatcccatgagtttatttacacattgtacatgagaatttgcgctatttcctatcttcagacgtgatatttaaaatatataacaattagtacaacatagggcactgaccaatcagaacagacaccagccaaactgctagagcagcttcctggatgctgtgcccttcatgtccggattatgagtacacctctggtgggctggggcagaggcatggggcagggtctcaaagtggcttctatttaccatgtatataggattgtttcaatattttaacaacttgtatggtcatgtatactgactgaatagcaactctgctatgagacataagacatgtttgatgacttcatgcaattttctgaaacatgctctttttttttttaaaataaaccttgggcagatgttatgttaagacagtctctgtagtaaaataatttgccatattggagaggcttatcatctttacaatgaaagtcagaaaatataagtaaaacatattaagttgtactaaagcagagagaataatcaaatataatcttactcaagatattttcatgacaactcagcttgcaagatgttttcctaggcttactgggtcataaatattcggtatcattttttttcctatattttaaagaaaaggaatttggaacatgtaaactataaatctaagttttaaaaaatctaaacaacagtttcctctcattgcagacctcattcaaattgcaggctggagccatgcccaatatgcctcttcagagccacaactacccacaggtaggtgggcacttggtgagtgaggataaaaagtttgttgttataagtcattgagttgtgcagttgtttgttacacagcaaatgacattccttttttacttattcatcattcattcaacgtattctaaacatataactatgaactataaaaactcaaaactggcttttcttttaaaagattgactagacaaatttatgttaaaactaatcaggaaaggaatggagatgcaaataaacaacagcacctatgaagtttgcattctactattgaaacagaaaatacacaaataaactgggaatcccaaatggttcataagcaaacgaagagtgacttacccttactctgtaatcagagaactgcaaattaaaacaattggaaagtctgacaatatcatgcagtgatgaggatgttgggaaataagagacctcccattcaacttaagggaaagtaagctgttgcaaccattccagggagcaacctgaaagtacttggtaaattaactatctttatactttctcaatgatgtagcaattacacttctaggtctcttgcacatgtccctaggaatatttttcacagcaatgtttgtggtagtaagaatggagaaagtctagatgtccattgacagaggaatgggaaataaaataagggatagacacataataaagttatattcagcactcagaaataatgttctagattaatatttatctggatggctcttaaaatatcatgacaaattggggaataaacaatatgagatttataaaagaataactttcaaggatattacatgcatatgcccagaaacaccaaattcatctttaaagatacacatatatctaaatgaatatagcaatgatatactggtagggtataaattaaatatgtaagggtggggtgaggtgagaatggtggatgcatgggaaaaaggtagtaaaaagtagaaaggtaaaatttaaaaaggggtattgcacagacgctgaaaatgtgcaatgaaatgaagggtgtgattaattcaattttgtgacttgatagtctaaaaataactatatgtagtagaatctgaaatatgaggaatagggaactttaagggagtatatggaagtcaacgccgtctaagcatgtgcacactgaattctcacactttcgatgatgtcctgctattatatcttttctaagcttagaggaagataaataccacagtagttatattttaattctagttttatttaggtaaatgataataatgagataagccacaaagttcgaattgacatatctattagtattagtatacataaatgtagaaaatatatttcaaaagaaaaaagaacgtactatgatcatcaaaaacctcacctttccacatgatacatattgttgatattttgatatttttccaccatggaatttattttgcaattaccttgttaatcagtataatgtataatgtgaggattaaattgcatctatggatcttgatgtgttatctttagaacttatttagattgaagctttcattttatctttttcaaactactatattaatgatcttgaatgaagattattataggagttcagtgcctcgcaaaattttcttgtacttaccctgtgcttcatactcttattgtcttgcctcctttgaataatcacaaaagaaaaagaaggcaaaggactatatagcacaacctattagaggaaatggctgaaatagtattctcttaatgtttaatgtgactattaagagggtattatgctggcatgtaaaacagttaattgtattcagtgtgttttaacatcactgattaattgatggcatagtgaatgttcatcttggagaaaataccacctttgtatctcaggggatctaaagaatgtcttttgctgctgaataaagtgcttcaaaaagttcaaagggagaaatgtgtatttttttttatggtaaggaagaatagattttaccacttgggaaagtaacagcttatgaaatcacgcagtgatgactgtaattcagctgtcgtctgtttctttcaccttctaaccagtgaaaaaagttaggttacttatttctttgactaagtaaattgaaaaggaataaattcagaaagattatctaaggaaactggttattagagcaaaatggtttgtattcactctgtaaatgaatgctcctgctgcttttctcttcattttaatcataatatttcttttttccagttgtttcatgtgaattttattttattgtttgtttttgtttttgagatggagtctcgctctgttgcccaggatggagtgcagtggtgccatgtcggctcactgcaatctcctcctcccgggttcaagcaattctcctgcttcagcctccccagtagctggaactacaggcatgaggcaccacgactggctaatttttttgtatttttagtagagatggggtttcaccatgttggtcaggctggtctcaaactcctgacctcaaatgatctgcccgccctggcctcccaaagtgctgggattacagcttgagccactgtacctggccgtgaatttttaaatatatcacatttcaaaataattttgcagttccaaaataattattttgtaattcaaagacagttgaataagcaaatcccttgggatttgattgtgtcagaattataaggtcctgcttatttttatttttatttttggaatttgtctgatggttgcagattattgtcaccggttcctcacgtttgttcccaaaagaagtaggatttgtgagacttggttccacctttgattttgatccatccctctgaatcaggctaagtcacagactccctaggtcattgccacaattttataagtaaggcaactaaaaataatctatagtactcactttcaaaagatcaatcactcaattcactgagtgttaataactgatttagctcagggagaaggacatttctcttattattctctataagaaggtaaaatatctaggttcttacatttttgaatagcaaagtaatgttgaaattagatggacaccttgacataaatctgaataaaaataacatatctcaggaatcttttagtattatattattgatataaaaattattaaaataggctgagcgctgtggcttacgcctgtaatcccagcactttgggaggctgaggtgggcggatcacgaggtctggagatcgagaccatcctggctaataaggtgaaaccctgtctctactaaaaatacaaaaaaaaaattagccgggcgtgacggcgggcgcctgtagtcccagctactcgggaggctgaggaaggagaatggcgtgaacctgggaggcggagcttgcagtgagccgagatcgcgccactgcactccagcctgggcaacagagcaagactccatccccccaaaaaaaaaaaaattattaaaatagcaatattattaatgtctacacttggtcttagccaaaaggccaagaagatatagtttcttaaatttctgagatctttctaatttataaaatgctttaatatacagctttatttttattaatttaatttaatttaatttatttattttttagatacagagtcttgctatgttgcccagcctagacttgaactcctgggcccaagtgatccttttgcctcagactcctaaatagctggtactaggcgtgcgcatcactgtaccttacctccatacgcagctttttagaggcagaaactatttcactgacttctatcccttaaacccagaaattgccagacataggttaataagtgcctaaagtaaacttcagtcttttgttgctgtttcccacctcctatatttgaggaattctctgcaatatgtatctttaacagaagctccaaaggccatgtgctctatatcccatctttctcttcaactacagcacagtaacgtaacttaggctcacctgatcagctgtacccagttgaactttcgctgggagctggtgatgcaaaagagtagcaatggtggagaatctattctgatagtggcagcagtatagatagcaacaacctgttccagggcagtagtggaaatgaaactagtggtggcatacggtggctggtgcctgaggtgatggctgtacatgtggtggcatccagtgttcagccatggtgggagcagtccccttatgaccctggatctatggttttacttgtggatctggctggtgcatagtgctcattgttgatcttccctttttcaaaacttgtttctttattcttcttgacaattctcttagatatataaaatccttttaataaattctgcttaaattagaattggcttctgtcacttgcattaatatacttgacaaataaaatatgaaactgacttgcatagctctataaccctatcaagacaggttttacgaatactgtttatatatcagtaagcaaagactaagagacagtaatttacttggctaagattaacgtttagtaagaacgaagagccaggaatcatacatagtcactccgattctatgcctgggtctctttcttccctatcacagtgtggcagagatgggttaattttctaagtacacagaaagcttacatttcacaacttctcttttaattctcagcatcatcacttggtgtagagtcccccagagagcaacctgatccatatcacaaacctgagacaaattttggttgccttaagcccttacaatttggagtttattcttatagcagctaatgatctttactccaattaatgcagaaattagtaacaaaattgaggtgctgtcataacaaaaacttaaaatacgtgacattgacagctgttagctggatagtgaggagagagataccagagatctatgttatatggtggtaaaatttttggtaaatttattaccttcttacaagacagaaaatgtacctactgggcttgtcgttttagaggaagagtttgcaaaatcaaatgttggcagagtttgttgggactgttggcttatttggaaaagtgtagtaataaaagagatgttcccagaagaagattgaccaattgatgaacagaaatgaaagtagagagagaacagaaatttagagcttttcaagttgaatagtcctaactttgaaaccctaaatggtaagaaatggacttacaaaaggctttgaatgaaagaagtccagtacaacttgacactaatagttggataaagggactcacagcaaagatcagattagggtatgccttacacattgtttgctccagatagactcaaaatacctgccattaagtaaaaagaggaaccacagtggcaaagaagcaacacagatcagactagacaatcatttctaggaataaactattggtatagttactggcacgtggatttgattggaaacaaacagatagaagaatataaaattttgaataaatgattttgccaatggagtcatgaaattgcaataaaaaaacacgtaagatatcagaatttaacacaacctgcatgtcctagaccttcaagcaggtggcaggcagtaggcagtagacttgcacattcatatagctgccaaaaaggtcatgtgccccagttcccactgcagatgcggtcaaggagaataacagacagggggataccttccagagggtgaggacattgcataaaagaactctctccagaaggcataaacagtgcctaatgaagaatttctcctgtccccaaggcaatgtctgcccaatgggattttaaaattgccccaaaccagttgctgtgtttctttttccccttctaaatggaagcgtttattgtggtaattgtaacccttctccaccgttgtaattagatatgtatttattgtctttttagttcataggtctccggagcctggggcatcgcatctagatggaaaggactgaatatcaactgaagagcctaaattttgggctgatgcagtcagtgattaagagttttgagtcagtgatggggcgaatatgtttcatgtgtggaaagataaataaaagggatgatgcatgaccagaaaggaggactgtggcagaaacagcctagatgctcaccaatcttatttctactgtttgggcagatggaaactgctatagttcaaagcctctcttggagttagattgcaatcatatgactgagaaatagaatgtgagcgaaactcactggtgtcacttccaaacttggctctttaaatgttcttcacaatcattcatgtactcactctactgtcttatgactattgtacatattcatgcacataatgatgtttccatacatataatgtgtaataatcagatcagggagagtcgcatatctatcagctcaaatgtttatcatttctctgtgttgggaatgttcaatatcttccttctagctatttgaaactatatattattgttaactcctgtcatcctacagtagtatagattattataagttattcctcctatctagctgtaattttatatcctttaacaaatctctccctgtctctcagtaaagtatcctgagatagtggaacttctctggttaacacttggaaaagaattgctgaaaagagctgtctcaccaactttgggctgtgattttgttttgtgaagtcattgtgattttgggatggttgtttatagcagctagcaagtcttagcatggcaaatacagtaactgtcatactaaaaaatatgatgcagaataaattatgttaggtagattaaataaatctatattattaataaataatatttgtaagtctgaattttatctgttggaatgtcagaaaagaatggggattatataaaaaagaattgttagaaaccagagtgtatcctatataggatcattagtgaagaaatagatggaaaagtggaaatgaataactatttcttccacacagaataaaacccagaaacaaagaaaagttaagtagtattagatagtgattcccaagcctgggaatgggagtcagtgatactcacctaggagagaatattaggaaggagtgagtgacatgaaaaaaaaagtcacggagggaaagggtaaagttttagtaagtcctatggatgacaattatgtattacctgcagcttgtcctactagaggaatagtctctgtgccaagaggaaaaaaaaaggctcagaatttctgatctaagacataggtagttaagaactcaaaaggaaaaatgtagtcagtgtataagatgatggaaatcttgttttaagagaactgaattattggagaatgtgtaaagaagaaagaggtgttaaacttttgaaggggagtcagatttgctcacatttttaacctttaacagtttcccactttttttttgaaacggagtttcactcgtgttgcccaggctggagtgcaatggtgcgatctcggctcacagcaacctccacctcccaggttcaagtgattctcctgcctcagcttcccaagtagctgggattacaggcccgtgccaccatacccggctaattttttgtatctttagtagaaacagggtttaccatgttggccaggctggtctggaactcctggcctcgtgatctgcctgcctcagcctcccaaagtgctgagattacaggcgtgagccacagcgcccggccatactttattctttatgatacaatgtctcactctgttgtccaggctggaatgcagtggcagaatcacaggtcactgcagccttgacctcctgggctaaagtaatcctctaccccagccttccaagtagctgggaccacaggcgtgcaccaccacgcctggctaatttttaaattttttgtgggtatcactatgttgcccaggctggtcttgaactcctgggctcaagcaatcctcccatcttggcttcccaaagtattgggattacaggagtgagccactgtgcctggcctggatgggtaacctttgaaaagttatgtaaaatctgtgtgcctcaatgaggatagtaacagaaacttccctggaattacttgaagtttaaatgagttaatctatgtaaacaacctagaacgggccgggcacagtggctcacgactgtaatcccagcactttaggaggccaaggtgggtggatctcctgaggtcaggagttccagaccagtcaggccaacatggcgaaaccccatctctactaaaaatacaaaaactagctgggggtggtggcacatgcctgtaatccccactcctcgagaggctaaggcaggagaatagtttgaacacaggaggcagaggttgcagtgagtcgagactgtgccactgcactctagcctgggcagcagagagagactccatctcaaaaaaaaaaaaaaaaaaaaaagaacctagaacaatggctggcatagaggcatagaataagcattatatgtattagctatgattacaaaagaggaatctataaggtattctgcagacaaagagaaggaagtggctaatttagtctgcagagtagagaagaacctcagagagctgcaatttgcaaagcaaggaggagagatgaatatttgttttgttttgttttttgagaccaagtttcagtcttgttgcccaggctggaatggaatggcatgatcccggctcactgcaacctctgcctccaggattcaagcgattctcctgcctcagcctcccaagtagctggaattacaggcacccaccaccatgcctggctaatttttgtgtttttagtagagacggggttttaccatgttggccaggctggtctcgaactcctgacctcaggtgatccacccgcctcggcctccctaagtgctgggattacagtcatgaaccaccgtgcccggccgagagatgaatattaaaacatatttgagggactttagaaattgtcagtctttaaagtctgtaagaaggatggtctggatgactcctttagcatgaactcattatttagtagatgactccatcccaattagtatttatgcctgtggaaatctcatatgaagagctagatctgattagcagctctattatatctagcttaatgctcacaatttgttccacaaagccattctctctctctctctcgtctttccctccttccattttgttagatcacatattataatagttatatgctttaaacccttatttagaacaataaagatgactgacttacatttcagacattgtcgctccatgtcgctagttttaaaacctgcccaacttagtaataaaaagtaatggctcctcagataagagtttcatgatagtttcttagaaacgagtcaatgacactactgtaatagcaggggaaaagatttctaagtcacatcatattttcaaactgacaattttagctacaaaagtacaacttccaagaggtctttcccaggtaaacatggaagggatttaccagtccacagaaaagtgactgcctctcccttggataaatgagattctttgcttcctgaaaatgagaaactgctatttcaatttcaatgccaaagatcaaattttctgactactgtgaatgaggctgctcagcatttacaacactaaaaacaaagaaaagaaagccgaagaggaacaatttttttttagcatttgccccaggcctttgcaatcaaagcataacccagcttatttttggggtgactacaccctccattctccaggtagctgaatcttccttgcatgtgtgaaagcatcactgacaaagtttcgttgtcatggagtttttagataagtatctctgagtttaaaatcccaaattatatgcatccacccacccttatactataattaatatctgtcttggggctttttagaaataactacacacatcaacagtttcacaactgcttctgtgagtggtgagattagtaggcagatttctaggggaattatgcaggtgaccagtcattaatatgcacattgttaaaatgtttgaacgttgtcatgatgatgatacagcgccgatgagtggaggaacaccaagttctacgtcctcatgctggtttagataaaacgacactgacacacgtggagtggttttaaggagcggaaagtttaataggcaagaaagaaaagagaaggcagaaggaagaggctctcctgtacagagacagagggaggggggctccaaagccgagagagggaaccccatctggcagggataccagccaggtatatatacagaggctggaggaggcagtgtctgatttgtatagggctcaggggattggtttgacaaagcatgtcattcatatagcccaggaaaaagcctgccctcccaccctagccttttaatatgccaatgcagggcaccatgatgttctacccacgtggggatatgtgggggcggccatgttgccaggaagtgtggggcaaggtcaagatggcagtgggaatagccatgtttgggtggacccagtttctaatggatggcatttgcatatcaaaggttgccagcctggctctaagagctgctttaaaaacgaaaacttcccaaggaccccttttcctctctatctgcctaaaataatttcttaataactcctacaacaatgacaccaaggggccaaattctaagattccaccaacatgatgcagttggcttggcacttcataactcaattaaagggatttttgagggttgttgccttaggtgtacactgcatgctttgaagtttttcctcataaagaacataatgcagtaacttaggagagaccattaaagcatttttccctttaagaactgcagcaataattataatctggtagctactttcttatgttcttgtaagataactagtcatcaacaaatttttttctctattaatttcactgcgatcaaatatttctcaatgaaaataaaagataggaatttcctgtatatatataaactcagttattttgaaacaacacataacattagaattgagaaagaccatggaaatattgatttcagtgtgaatgaaaaagaaaaacttgggaccttaattcactatgccaaaaaagaaaaaaattaagctgaaagatgagtcatgcaagaaactgcctttccttttgttcctaagcagatagctacagataaaagttaaacatctccactgactgctactccatgttcaccttattttatgtaaagtgccgatttactgagcccaagatcaatacttaactgacaattcccctacttattcattttcctctgcagcttgtggattaccatactctccccttttcccctccagctggcttttcctctttaaatattgaagcctgcaaattcatccttggagaaaggcacagaccacagactgcttctgttattccatgttcatttcttcctggcatgtccttaaccttggcaaaacaaacttctaaatctatttagatcacagaaaggattttttatttctatacttctttaatgtgtttttaaatgtctgcctaatagttcatgcagttgatattccataatctcatcatgattgagtttatttctcagctgtatagaagaggacacaaaggaacagaaaaggcaagtatctcatccaggattacctagctagtaaaatgaatgcaggaaaaagggaaaggccaagaacagtcacatctatctgtcttttcattttgtttcttcttttgcttttcatgcttagaaattctttctccgcctagagatgaaatgaatattcaattatggtttcttccaattgtttctggtgctcatttttatatttatatttaacctaagataatctgggatatattttggtagaacaaataaattagatgtttgttctaagagaagtcttgatgaaatgattaaaaagtttatctataagaattaacagataatacaactgagaaatctttaaaaggaagagtactggaacaggtaacttgtactgacaaaaattgaaactgataatcatcgtaacaattagattagcatgcaccgttttaaggaaaacaagatcaattctatttagcataaaagcagcaattaaaatgatatgaaaatctgtttttctcagacagcatattagtttattaatttagtatttgataattttttcagatacagataatatctaagtgataatttaaaaaaatccaaacatcctaaataaaaatctaagccaaaatctcataacaagcctgtctcttaatgagctgtgacagtgaaataatcctttttacatggtgatagctgatattgtgatagctgtaaacttagctgtcatcacagatcttggctacagaggctgctgtggtaacgagtgaacctaatgggctttgtttacttgagtgaggagttttcttcatgccccaaccctgcccgcttgcaatgtgcatctgaagccaggaggatgtctctccaactgatcgtatatttctttcttgtttttcctttttttttttttttttttttgagatggagttttgctcttgttgcccaggctggaatgcaatggcacgatcttggctcactgcagcctctgtctgctgggttcaagcgattctcctacctcagcctcctgagtagctgggattacaggtgcctgccaccacccctggccaattttctgtatttttagtagagacggggtttctccatgttggccagcctggtctcaaactcctggcctcaggtgatccacccttctcagcctcccaaagtgctgggattacaggcatgagccaccgtgcccagccagatcctactatctttctacttttgaattgcaatgtggtttatgtctttggattttaataagcacaaaactcctcctagaattagcaagatatcaaaaaaggcctccaagtggagagcatttggccttgacctcatgtaggaaagaaaggagttggccaggtgtggtggctcctacctgtaatcccagcattttgtgaggcagaggaggatggatcacttgagctcaggagttcgagaccagcctgggcaacacaacaaaaccctgtctccacaaaaagtacaaaaattagatgggcatggtggtgtacgcctgtaatcccagctagtagggtggctgaggcaggtgagttgcttgaacctagaaggcggaggctgcagtgagctgagattgtgccactgcactctggcctgggccacagaatgagacactgtctcaagaaaaaaacaaaacgaaacagggagagtttgaagaacaataattctataattaaagtgtttttagaatagccctcaaggatcctctttctatcttttatactaccaaacctataaacatatatgtggtttccaggatgaggaacacaatacttgagatggaaaactaaagaccggctatgagctccaaggttgaggaacatatttgctgaacccttttccttaaattacatttatagaaataggaaaaatggaatatctccattaggcataattcaaaagcactgaagaagtgtagggatgtgaaaacacttctaaaaaagcaagcttggcaaaataccaacttttctcgaggaaccaatccattctatttttctgtttgtttgtcccaggttcttaagcagcatctgatttctaaactcttacaagggtagtctggataaagcacgttttattttctctgttgaaaactaagtattgcttaaatggagaatcatgccttatttggtagtacgcaaaggtttaaggcattttttttccttagatgagggatatcaatacagaaaagtctgtcactctgttttaaaatttatataagctcaaagtttcaagtgctagttcatgggggaaagaatttgtttattttttgtttttgcattttctatgacatcttttagcataaagccttacagagatcatttttttaaatagtagaaacataaatgcttattgaactgagcactctagccaaggaaaaacttttcattaattttgagataagaggcaaaaatgaaagcatattataaaccttactgattatttcttccttactttggctattggccatcttttagttgaagcatatacatttattaaatgtattaataaatacattaaattaataaagtcccatattaaagaagtttatggaaagatctctccttatgtcttagtgttctcttccaggaagagggtatacagactttataggaagcagatattccctcttatcttgtaatatatgtccttgtgcagcatgagaagaaaactttaagatcacagactagcctaagaaaaatgatttatctttcagcaaatatttctcatccataatttactttggcttacttctgtgtctacaagtgtctgttgtagcatataaatgaaactagtttcaaacaacttttcaggtgcaataacaaaatgtatgtaccagagcttctggatagctgaacacatgtcagttcctggagggcggtgtgcccagggatggcatggaagctctgtgccccttcccctatgtctcaccctatgcacctcttcatctgtatcttttgtaatatcttttatttactttttttttttagagacaaggtcttgctctgtcacccaggatggagtgaagtggtgcgatcttggctcactacaacctcctcctcccaagttcaagcaattctcctgcctcagcctcccaagtagctgggattaccggcatacaccaccatgcctggccaattattgtatttttaatagaaacggcatttttacagtgttggccaggctggtctcgaactcctgacatcaagctatccgcctgcctcggcctcccaaagtgttgggattacaggcatgagccaccgcacctagcctgcaatatcttttacaataaaccagtagatgtaagcatttccctgagttctgtgggctgttccagcaaattaactgaacccaaaaaaggggtcatgggaactgcaacttgaagcgcggtggtcagaagttccagaggcccagacttgcaactggtttgtgtgtagttggcagtcttggggacggagccctcagtttgtggaatctgactctacctctgggtagataggattggaatggaactaaagaacatccagctggtgtctgccgcttggtgtgttaggaaaaaactccatgcatttggtcatagaattcttcttctgtgttgatgactgttgtgttgtcagaggagagagaaaacacagttagggagagttcccctacacaattgatgtcagtgaaatgggatttgctagaacagccctcactcacagaaacatgtggtttaggaagagaaaggctaaaaggctgggaggatgaggaatctttgattcctgggtgaccatcgtggtcacccatgatatgaagttgcagttgtgttgagatcagttactacaggtgaaagttaccagcggaatttagagatggatagaactccccaggaattggttcactggatgcaaaagggaatgcaaactaataagaaaaaagcaaaatattcagtcctttggttgttgttacttaaaattgctaaaatgaaagtaaaatagggtgctgcatcaggacttgaagttggaccaagttcagatggggacatgtctgagcttagttaggccactagcctcaaagtcacacacaaaggagaaaattatgcagggacagtagaaagtacctctgaaacctgtggaagacagtcaatgtgaaggcagggcaaaaccaagtaactatttaaactattagagtaggtagttaggtaggcatgagcaggacaggagcgaggccccatccagaaatgccaggcaaccatcaggtgatggttagttggttgttaaactgttgctctaaaataataattggtcacagccagtgcagggaaaaacagtctcccaataaatagacaatacctgaaactggtgatcagcagcttcctgataagatttcaggagttgggtgaacaggctcaagaatgcccactaaaaagcaaaatggcagagattaactggtatatgatctttctctaggaaaacctgactggtaaggaaaaaatgcctcaaatgagcatgtgtacaactttggcaaacacagtgtgcatgttgcccctccccaagtgctggcggaccagtgtgcatgcagatagcccaccccaagggaagaatcaggggagaagaaatgcaaaccttggaacgatgccaatgtattctttcctccttgcaggcaagaatcgtttgctgcagacctgttggattcacagctggtaacaaaaccggagagtatagtgtgaaggaattgtttcatttttgtagaatggtgttatcagcttcctgaggaactattgctaaaatggattataagaatgacaaatgtaggggcagtgtctttggtttcaaatcttgcagagtgaagagcatgtttgggttgatataggacccacagctgaccatttgaacaatcacagatgggtatatatgatccagatatgtaggttattccgcaaggaacagccagtctgatagattggataaaagccattataagatctatttgagaaggtggactgttgaactccacctataaatgccaagtggaacaccttacataaggcagctgatacaattcatatgcaagccatgtgtgactggctttatgaggacatgaatattcactcagtgaatatgtccattacccaggtcacggtaaatactctggttaaggggaccccatgtgacattactcctgcagactcaaatagttcaagaagccttatcaaatttgtggactgagtttcccctcatggatctcacagatgctaataaaaacattaggttaattaataagagaacagtgaaaggcaaaagggagagtcaaagactcatccccggaagatagaaattttaaaatggttattaaaaaataaggtgaatgaagaaaacattgatggggtgaaactaagaagaaaaagaaaggggagagtcatgggactcgtcccagcagaatggaaaactttagatgcttattaagaaatagaatcaataaaatagacattgatggggttaagcaaaggtcttaatacaacactattgtaggttggatggaccagagggggccccatcttgtcccccaacattaaaaggccgcaaaccagtctgctgtatttctgccagcttggagaaatttaaaaagctggaaggcagagattacaatgaaaaatcagatctaaaattgcctggggcaacagtcaggcagactaatcgagataaagattaataaaagggccagggtccttgggctcaatccttggctggggacccaaagctttttacacaagagagggtaaaatgacctgggggtaaagaagagaagatcctgaaactagaacataaaaatgtaagagttgataggactatggaagttggtatatttgaaaacactttatgtgaagtgattgcatctcttttacctgatttttttttttgtgggaatgaacaaagtatctcattgggaaatatttctcctccctggtgctgtaaaacagaaggcatgtaataatctgccctcaagcaatattaattggacatgctaaatgggaaccagtgagattgcccaagtccacacagtgcagagtagaagctagaatgctgttatggataaattctccacttgataagcctctgtgatgctatttcctggatcttgtggcaaaagcctctgagcacctcccagcaacatctactgggactttggactatggaacttccatctgaggggcatttactgctttgctgtgaaatgttaggtgaagctaccgctattaacacctgaaatacccatgttggcccagcgatgtcagagaaacattctaacagggatggcagtgcccaggagagttccataataaaatggacatggtttatcgaggatcatgccacctaagaactgcaaggaggggatactcttgagcagggtgtttcttttctcctgagactgactctggaactgtgtgagaaactgctggattctacagtgcctgataaatggctctcaactcatgagaaagagctacttagtttgtggccagtaattccaaggtaaatggacaccattgtgtttggaaggcagctactttgataaaagaaggtaaaaacagatctgcttggtgggctgaattgcacactgtttttctaacagtgatggaagaattgatcaatggtaaaagcccctgagtttgggtgtttactgagctgtgggcagtgtgacccatggcctggccatacactcaggcaagagggccatggaaatttggcctattaaatggatgcacataggagcactgttctatggagatttgaggggtgcattaaagaagaacaagtgaatgcccatcagaagaactcccttccaggttcagaaagtgactggaattgacaagcagatatccccatgtactcccttgaagtggccacctgggcctttgaaatgagtggatatgggagtattgtaacagggcagagatgggctgaatgtagagatggtttttttgcaccttctcaggcacaaaatgccagaaagaactgttgtgtttctcaataagaaagccagagactgctgacggctttgggacagattctctggtgggaaggccctgaacatagctggcaagtgcgacaaatgctggtagccctggaggctacaaatgggtcttgacaggaatagacactggctatggagtggatgttgcttgcccagaagaagatgaaaattctctgagtgccataaaaaaccggaacagaagatattacatggatatagatggctaaccatcagtttttcagaccaaggaacacactgtacagcccataagaatagtccaacaatggacaaagagatatccacctagagtaatagtttgatagagcagtagagcaggcaattgaaacattgattgtgtaaaacagggggagataaaagcacaaagggctggctcacatgccttcctgtctgctcacactcaacatgagcaggactagagtgtttctgctagattttttttctttgtttttctggttgatctggggaacagggagttgggaggatgctggtatgactatgccattcttgccaagggacgagtacactggtataacaaatgtaagtttttctttcttccccaaatcacctaaaagaaatttatttttttctcccctggctgatgcagtggtcctaggaccaggactgcaattacaactgctggattagcaggggtgatttctaagcaaaaacctgtaactgtgttttgaaaccttatatcaaaattcccaaaggcatgatgggagtgggttgtgtcttcatgctatctagaaaaattggggctatcagtgaatgcagctatattgcctggtggtaaaaatagctcactagttctgcacctatgtaaccttacccggtctgaattggcgtggactgagaaggagctaattgctagacttgtattactacttgcaatgtagaccggcactgtggtggttctaatttctcttccaaaggtgaaaaggtttaggtattaatggagagaaggagaaatagtagctgagagtaaataaatgaataaatgagttattaattgagaaaaattcagtattacataacaactcaaaagagtctcagagcaagagatgacattgtctcttagcttaattatcccagatgccttaaagggtgaagctgcgtatttactgaggccactcctgctttcgagacctgacaagattgagaggaaacttgcaaccctgagtggcctcatcctggaagacattcaaacaatatgaaggatttgattaattgttaatgattgtgcataatatatatatttttgaagtaaaggcaccatggtggaaaaccagggagtggcctgtggtgttatgatatacactggttttagtccacagttcctggcttataactcctatatcccttgttacaatattttcttttttttatataatgttgggtatgttaggcctcaggagcaagcctctgaccttctcctgccttactttcactctaatgtttccccactttctaattgtgacgcttaagactctcacaggagagggttccatcctatatcctgagggaaggaatgctgatgtcatgaagctttcataaaaacccaagaggacagggttcagtgagcttccggatagctgaacatgtggcacttcctggagggtggcgcacccagggagggcatggaagctccgggccccttccttcataccttcccctatggttctcttcatctggatcctttgcaatatcctttataataaaccagtacatgtaagaaaaaaaaaaaaaatgtacttacagtttccttccttccttccttctccttccttccttccttccctccctccctccctccctccctccctccctccctccctccctccctcctttctttctttctttcttccttccttccttccttccttccttccttccttccttccttccttccttttctttcctctctctctttctgacaaactctcgcactgtcaccaggctggagtgcagtggcatgatcttggctcactgcaactcctacctcctgggttcaagctattctcctgcctcaacctcccaagtagctgtgactataggcacatgccaccaagcccagctaattttttttgtatttttagtagagacggggtttcaccatgttggccaggatggtctcatctcttgaccttgtgatccacctgcctcggcctcccaaagtgctgggattacaggcgtgagccaccatgcctggccaacctacagtattttttctaaggccatctctagctgcatacttaccacactaggtaaattttctgtaaaggcatatgccataaatcaggatttttttgttgtggttttttggtcaagattagtttctacatatcatccagtatttgttacgtctaatgagaggttgtatatatacatgtgaatgtttcaggaccatatggcaattattccatttaaaatattgctgtcctacttctcagaaaaaaggcaaggcataaattattgtttttactattttaaaaaatgtagcccttcatcagagcttagatctataggtataaattactaatgctcatccctttccagtggcaaaaaggagatatcaaattattttgagatttgagtaagaataaaattaataaatagcaagaggacaggtgtgtgaaagttttcatatgagtaacgctcgggttacttatttctttccttttaacaagaattatttagcccttgcctggctcttgctgcagtcaatttgagaggaaaggacatcttgccattgattttaattattcccagtcatcccattccttttttagtagattgaaactctcttgggctggttttctagctccacctacgtattggttggcactgtcttcatttaattttgcctgttattattccttcataatgcctttccctgaagtgacagaacatccttcacctgccaaggtcagcagtttgctacaggagatgacacttccaggatcatatgccaagtctatgtaagggcacaagcgaacggtggtggtaactaatagtcttaaagttatcttgtttattcttatttcagctttcctgctatattttttgcatactctctaaagtaatacatggtaattggaaaaatgtgagaagataaaaaagaaaatcagagagaatgagattgtgtattaattagttatcaccaaacaaaactccagactgtataaataccaaacaaactccagactgtataaaaagtaaaaacaggaaataatcatttcaaaatttcattggattaatgttttctattcctgcattcttccccctccttcttacctcttcctcctcatctttcttcttttccccatgtcaagtaatttccaagatggcccaggaataaagatatgcagttacaaaacattctagccctaactagtaagaacaaatattctctttctgtgaatagaaaggatagatggatctgtatatacacagacttgcatgtgagtttttagaatatgtacatcagttagattgtgttaaggcacaaagccatagagttatgccccacattaggaaatacttccaggaatgtgtattgcatgaataaataaatgaaccaatagcttactatgtgtcagattctttgctgtcctttaaatagatgatcttattgaatcttttccccatattaggaaatacttctaggaataagtattgcatgaataaatgatgaaccaatagcttactatgtgtcagattctttgctgtcctttaaatagatgatcttgttgaaaattcactgtgaaaagaatggggatctagcatgataaaaagatacttgttgactttatggcaggacacaagttacacattttgcagacttaagagaggctgtgtggcctgaattttgaagtagtacctactgctatagtagtgggcactcagattttgtagaattaggcttatcagaaatcctcagtttaattgtacattctatgcacttaatatttgagatttgttacattgtattggtgtctaatattttattcattccctatgagtgccagaaaaggagtgaaggtagagaatatttcatttgtcagtattccatgaaactactgattatgggaaattcatgaaagagcttacagtttaaaattctacaatggattaattaaatatatatatctgattacagctgaagttcaagtccctcagatcaatcagcagtattttcagagataagtagatttatttcttaattaattaattaatatttatgtgtctattaaatatggttcttcattgcacatactttgaaattttttttcttttttagagagagtgtcttgctctgtcacctaggctggagtgcagtggcgcaacctaggctcactgcaacctctgcctcccaggttcaagcaattctcatgcctcagcctccagaatagctgggattacaggcacgtgccaccatgcccagctaagttttatatttttagtagagatggggtttcactgtgttggccaggctggtctcaaactcgcaacttcaggtgatctgcccacctcggcctcccaaagtgctgggattgcaggcatgagccatcacacctggcccatactttgatatttttaaccatcaaattagtgaataaattactgaataaaacttaaccatatctcttccatgggtagggagactatggcatcacaaaggaacagtgttgttatatctttacaataggaaacattggacaaagatggaagagtaaggacaatgttatcattttcattgttccatcatcataatgtgccatgttgtgtatagacttctctacactgtgtggctgcttctttggaatacacagtcctaagcattgctgggattgtgaatgtcaaactactactatagatattttgtatctcagaacttaaacttgatgcagtaattattgtcttaatcattggttttacccttcctatcattgtgttggaataaggtctttcctgaagtgagtactataagcaatagtatagaaatacacaagagacaataaagtacgtgaggaaggctgggcacagtgggtcacacctgtaatcccagcactttgggaggctgaggcgggtagatcacctgaggtcaggagttcaagaccatcctgaccaacatggtgaaaccctgtctctactaaaaatacaaaaattagctgggtgtggtagcatgtgcctgtaatcccagctacttgggaggctgaggcaggagaatcacttgaatttgggaggtggaggttgcagtgagccaagattgtggcattgcactccagcttgggtaacagagtgagacattatgtatatatatatgtgtatataaatatatatgtatgtatgtgaggaggataatagttaatcctaacagattaacttggaatcattcaataagtagactgaactaaaattgggaagccattatttggtattaaattatgggcaccaggggtaaatgactgactaatagagcaggaaacaccagacagagaaaggaatgaaatacaaatgatggtcagtagggaggaggtggtcaaggaaaatgagttatgaacagaaagaactctatttacaggctgacactataaatgcttgtaaatgaaaaataaaattctaaggcctccagtgaactgaatggaaccctcatcttggccaagggtattccaaagttaacctgaaacactagttcaagccatgacgggaatgagtggtcagacatgcctcattataccctcgtcctgttggaattcagtcactactgaccagcattaacattaaaacagagaccttggccggatgcggtggctcacacctgtaatcccagcacccgcctcagcactttgggaggctgaggcgggtggatcacgaggtcaggagttcaagacctgcctggccaagatggtgaaaccccgtctctactaaaaatacaaaaattagccgggcatggtggtgggcacctgtaatcccagctactcgggaggctgaggcagagaattgcttgaacccaggaggcggaggttgcagtgagccaagatcgtgccactgcactccagcctgggtgacagagggagactctgtctcaaaaaaaaaaaaaaaaacagagtccttaagacaacgaagggagacactgtagcaataagagaccaacatagcagacagcaggccctgaagaaaactgaaatattttaccccaagatatatttctttgacatattttgaaatggccctgcaatggtgtctgttgtggggaaaatccatattctgtaaagaattcccttccttttccaagtctttttcctgatccaggagagaattaactaagaatttggcacctttttaagtctgatgagaaatatttacagtgtattctctctgaagcctcccatctggaggctttatctgcataataaaagccttgatctccacaacaaccgcttttcttaacccagacactcccttctattgattccacgcctttagataaactcttcaactgtgaatccacctatgacctgaaatcccactccccacaagccctcccaaccaagttgagttgtcccacctttccagaccaaaccaatatacatcttacatgtattgattgatgttttatgtctccttaaaatgtataaaaccaagctgtagctgaccaccttgggcacatgttctcaggactcctaaggttgtgtcacgggtatgtttttgaccttggcaaaataaacttctaaattgtttgggaactgtctcaaataccctttgggttactccctgaactatgccagaaaatcattgacattgtgaagggaaaatatcttgggtcccccaaatcactaagctaaagggaaaagttaaggttgggaacctcttagggaaacctgcctcccactctattcagtcacccctcttctcactgagataagcgcatatctgattgcctcctttggagaggctgatcacaaactcaaaagaatgcaaccatttgtctcttatctacttatgacctggaagccccctccaagcttccagttgtcctgcctttccagaccgaaatgatgttcatcttacatatgttgattgatgtctcatgtctccctgaaatgtataaatccaaactgctctgactgccttgggacatgtcatcagaacttcctgaggctgtcatgggctcacatcctcaaccatggcaaaataagctttctgaattaactgagacctgtctcataatttgggggttcatgttttggtaaccacagagggattctaagtagaggtgcccctgacctttgacaaatctccttttggtgtttggtatcagcttgagctatctttatggctcaaaccaataggataatttgctgaggtctggaagcaccctctccagagaatccctgatcttccaaaatttggttgagatctacagtttattttggtacgtaactcctttttttgaattttacttgcttccaacccaaggaaggcaagttttccctgcttccataatgatggaaggcagataactcctttatggagtttgagctcacttccaacagggaagatgagtttttgttgttgtttgtttatttgttttgagacagagtcttgctctgtcacccaggctggagtgcagtggcacgatctcagctcactgcaatctctgcctcctgggttcaagtgattctcctacctcagcctcctgagtagctgggactataggcgttcaccaccatgcccagctaattttttatttttagtagagacagggtttcaacatgttggttaggctggtcttgaactactaacctcaagtgatctgcctgccctggcctcccaaaatgctggggttaccggtgtgagccaccgcacccagcctgatgagatcccctccgctgccccctacttctaggatggtagagagcagccttcagcctgaaatccatccctaggcaagtaaatgatgtcaggcctctgagcccaagctaagccatcgtatcccctgtgacttgcacatacacatcccggtggccggttcctgccttaactgatgacattccaccacaaaagaagtgaaaatggcctgtttctgccttaactgatgacattgtcttgtgaaattccttatcctggctcaaaagctcccctactgagcaccttgtgatcccccactctgcccgccagcgaacaacccccctttgactgtaattttcctttatctacccaaatcctataaaacggtcccacccttatctcccttcgctgactctcttttcagactcagcccgcctgcacccaggtgaaataaacagccatgttgctcacacaaagcctgtttggtggtctcttcacacggatgcacatgaaaaatgaagtggggtttgtcttggttaaagttaagatttccaaccgcctgatcttaatttctccttaccattagagtgcttggtaatcatgtaagttgtgcaattgtttgttttgcttaacttttgttttgttattgttttttgtttctggtttttgttgttgtttcagtctttttctcattgggtttgatcaactctatccaactagatcaaatccaaaggaagttccaaattatggaacaaggcctctgaagtggctaaattcccagaaaaacgacgacaacaacaacagcaacaacaactacaaaaacggtggtgtggtagcagagaaatataccagcaaaaggaaaaaaaagaggaaaggctttgattttgactactaataggctttatttacatagcaaggtggcctttttgctaatcaggccaaactgaaagagcaatggctattacttctgaaatagcagcaatttgtcctagctgaaatatggtaatgatatttaaaaacatattttttaaaggggctcagtggctagtcagcttaattaaaagctaacatccaagatgtgtgtgtgtatgtgtgcatatgtgtgtgtttgtatttaaaagaccctcatgcttttgtttttgcttttctcctaggaccttgtctctttttcgagcaaaagttttttcttctcagttgactgaattctgttttcttcacttgtttgtttctgctctctctcctttctcttgcaccctctgctgcatggggaacctaaaatagttcgtaatagcctggggttccttaaagaaaacagtgaaggcaccagactcccttcggaggagaaacctgtttttccttatggaaccccaagaatgcaaacagacaaggtcctctcagctcttaaactgcttactttttttcactcacgtccgtgtgaagagaccaccaaacaggctttgtgtgagcaacaaggctgtttatttcacctgggtgcaggcgggctgagtccgaaaagagtcagcgaaggcagataggggtggggccgttttataagatttgggtaggtaaaggaaaaagggaggttgttctctggcgggcaggggtgggggtcacaaagtgctcagcgggggagcttttgagccaggaggagccaggagaaggaatttcacaaggtaatgtcatcagttaaggcaggaacaggccattttcacttcttttgtggtggaatgtcatcagttaaggcaggaaccagccatctggatgtgtatgtgcaggtcacaggggatatgatgtcttagcttgggctcagaggcctgacacttttgtattgtgttacctggttttttgtttttgtttttggctaacatagttattgcaacagagtttgctcttgggtttttaaggaagagtgtgttttagacactagaaatgtctttgcttaaaaaaaatttttctaagtgcacttaaaaaaacttaaaaaagtatcatgtggtctaaccttattataattctcccattctggagaccctggaatcagtgtgggctctgcccacagctcagggatccagttaaaagataggtagttcctatctaaataaaactggtctccttatccaatcttacgatagatttctgtaattttatgtttgatttggcatctatctttaatctccctctagcatcaccagactttttctctcagtaccttgtgatgtaaattttgctatttgcatttcacctgagtcgtttcctttaatttgcaaatttaagcgtgtttacctgacaactgcctagggttgtgaaacagattatcaaaaatctgaaagtctaagatagggaaaaaaaggtttttataaatctataagatgtaatttatcagcatgcctaatatgtctatgtatttatatgttatgtacagaatgtttcactactcaaaatagataaaagagctctaattaattggcttaagaaaacaaaaatgcttgaatcaaatactttattggaaaaaagaaaagactagtcaaatgcttattcaagtttatgtaacttaagtaaaatctttaataaataagctagctttaaaattattggtaaagtaatattagaaatgtcttaagaattgccagcatacatttttgttttgtatttattaatcaagcaatttcatacttatccctgtcaaatgctatgaggtgtcaaaatttggcatagtggttacaaaactataaaaccagcccaagaaaatgatctttccctgtgtaatctttaaataaattagagattgatattggtgtaataagctacatcattttattttatttatttatttatttgtgtttttttgagacagtcttgctctgtcaccgaggctggagtgcagtggcacgatctcggctcactgcaacctccacctcccaagttcaagtgattctcctgcctcagcctgagcctcctgcctcagtccggagtagctgggactacaggcgcatgccaccacacggagctaattttttgtagttttagtagagatggggtttcaccttgttagccagggtgatctcaatatccttacttcgtgatccgcccacctcggtcttccaaagtgctaggattacagtcatgaaccaccatgccctgcctttatttactttttttgagactgagtctcactctgtcaccgaggctgtagtgcagtggcatgatctcagctcactgcaacctctgcctcttgggttcaagtgattctcatgcctcagcctcccaagtagctgggattacaggcatgtgccgccgttcccagataatttttgtattttttgtatagacagggtttcgccatgttagccaggctggactcaaactcctgggctcatatgatttgcccgcttcagcctcccaaagtgctgggattataagcaggagccaccaagtcctgccaacatcttgaatttagtaagattactgtgacttctaatcttgtggcttttgtcggtctagtccacaggcagtaaggtttgttttgggaaaggactgttatcatctttctttcaaagctaaactataaaataagttcttcccaaagttagttcaaacttttatcaaagccaatttaaaagcctatgtaaaaaaataattattcttgctgagctgtatacaaataatttggccaagtatcataaagcaaatgaatcctatcatgatttgtcttgagtaaaaattaaaaactggagagagaataactgtgtttcaaaacctatactatacctgttgttagattctaggtcttgcctaatgtttttcaatttttattattttctacagtttggaccaaattctaatttttcttggctacaagtcttcaaaataatgttctcatttttttcttcttttttttccccatttttcctaatttggagtcactgaaaactaagctgtgctttcgtaaagccctgtgaactgaagctagacaactcgaacttcagaagaaaataacagcaacctatttacatacataagccactttcctacctgcctccaatgtaaggatttcagagtaatgtggcctatatcaattttccaggattgttcttttgcttattgttgtttttctcccttcctccccctattttatctttaaaggatatgaagcttcacaacttctaaaaaatgagctttcctaataactcaggacctatctgcctaggaataacccattgtacccatgagaaattagaggaaatctgagatcagagactcattttcttttaacatgttttctccaaagattttaaaaaagaaaaggggggaaatgtgagagaaaaatatcctgcccccccaaggttactgaactaaagggaaaagtcaagctgggaactgcttagggcaaacttgcctcccattctattcaaagtcaccccttgctcactgagataaatgcaaatctgattgtctcctttggagaggctaattagaaactcagaagaatgcaaccatttgtctcttatctatgtatgacccggaagtcccctccaagcttccagttgtcctgcctttccagaatgaaacaatgttcatcttacctatgttgattgatgtctcatgtctccctgaaatgtataaaaccaaactgtgctctgaccatcttgggcacatgtcatcaggacctcctgagactgtgtcacgggagcaagtcctcagcactggcaaacttactaaattgactgagacctgtcttagatttttggggttcacaacattcattagctattgggggtctaggactgaaatttaaaggcatagatgaagtctgacagatccaatctgatgttaactttgggattttctttagttaccactcagtgccccagtcctccttaaaatactttacacctccaagtctttttccttccataaaagccaattgtttctctaacactaggtctctgccttgctgttacctgccttcagaacctggggtcttcccttcatagttagggttcccaccagctaagaattcacggcctggatctctgcatattgcctatgctcagattgccttgctgccatgtcccacctatcctgtcacacttttctcacctggagtttgatggtttccttgtcactcttcctcccttgcagtgtgctctactttgcttctctgggcagacccttgcataatcctgggtctgcccctatatgcctctagtaggagttgatgctgggcttgtattttggatagacccaatggtaaataaaccctgactgtcattcattcatctgtcaaatatcattatgctctaccatgtattaagcattatgctaggcacttgagatataatgagagaaataaccatggaggaacacaggaactctcatacattgctgcaatttggcagtatattgtaaagttgaacaggtacatgccctactctgcagctaattaatgtctcggtatctacctataaagactcttgtttctcctcatttacttcatttgcttttctttcatttacaacatattatgtaggacatacttttttttttttttttttttttttttgagatggagtctctctctgtccctcaggctggagtgcagtggagcaatctgggcttactgtaaccgctacctcctgagctcaagtaaggtggaggttgcagtgagcccagatcctcctgcctcagccttctgagtagctgggattataggcacatgccaccaagcccggctccggtacatgacttcaggtgatcctgacctcagatgacccacccacctcggcctcccaaagtgctgggattacaggcatgagtcactgtgtctggctgagcatgcaaaatttgtaatcggtagacattgtttataggcatgtttcataattataaaatgaattaaaaatcagtcacataaatatatgggctttttcaaaataacccaacatggaaaccttgatatccttccctagatctatggcagtctttgtagtctccatgacattgcacagcttgggttcagaaatgactctctagaaaaactgaaacaccacacctctgtagataatgatgtgcagctggggctcagccacttgtgttagtgaagttcctttcacaccaaagatactcaccccacttccatattatatccaatcatagtatttcaacttctgtcaaaattcccagtctccaactatggtgcagcagatcctttcaaatgtaaatacaatagcataaacttatatactgacaattctgtaacatacagaatttcattctgtatgattctatttaatagagtttcaaaatattcatatggatgaccataaaagaaagtaagattaaagatgtgctctttatgaaaaggtgtaacccacatttcaatcagggatactttataatctttaaaaaacacaccattgaccaggtgcggtgactcatgcctgtaatcccagcactgtgggaggctgaggcaggtgaatcacctgaggtcaggagttcaagaccagcctggccaacatggtgaaaccccatctccactaaaaatacaaaaatgctagccaggcatggtggcaggtgcctgtaattccagctaccagggaggctgaggcaggagaatcacttgaacctaggaggcggaggctgcagtgagccaagattgcaccactgcactccaggctgggtgacagagtgagactctgtctcaaaacaaacaatcaaacagccacaccatcggccaggcgcagtggctcatgcctgtaatcccagtactttggaggttgaggtgggcagatcccttgaggccaggagtttgagatcagcctgggcaacatggtgaaacccagtctctactgaaaatacaaaaattagccgggcatgatggtgcatgcctgtaacccagctactagggaggctgaggcacaagaatcacttgaacctgggaagtggaggttgcactgagccgaacttgcgccactgcactccagtctgggcaacagagatagacgctgtctcaaaaaaacccaaaaaaccaaaaacaaacaaacatacaaacaaaaaacaccattgtttttatttttattttttccctatttactacttccacaggaaaattgtttgatttttgctctattttaagccaaacttcatatgcagggtaaggctgaggcaaaacaagtgagaaagtggttgtagataaatgtaaacgaatgaccatgagatgaccctttcagaacttgtgcaacacgtatgtcaccagccccattagcctgtgttaggaataacgttcaaaatcctaaggaaattgaacactcgaacaaaggattcttagcaaagcaattttacttctgcgcacaggggtgcctccttggccagttacatgagagcacacctgaacaaaggggcaggggaacctttatttctgttgcaagtcctgccccgtacgctttttttattggccagggtcgggtcgtacaatttaaactaatctcggttggctaagcatttgattttttttagatagggtgggcacgtacaagaaagtggagaggaaggctggacgcggtggctcacgcctgtaatcccagcactttgggaggccgaggcgggcagaacacgaggtcaggagattgagaccaccctggctaacacggtgaaacctcgtctctactaaaaatacaaaaaaattagtcgggcgcctgtagtcccagctactagggaggcggaggcaggagaatgacgtgaacccaggaggcggagcttgcagcgagccaagattgcgccactgcactctagcctgggggacagagggagactccgtctaaaaaaaaaaaaaaaaaaaaaaaaaaaaaaaaaaaggaagtggagaggaaggggaagggttgtctgcaatgagctagaaagttagtcttttttttttttttaaataaggaaaggaatgcgaggtggtactgataatgcctggtactgtagcgtgcctgggcattaaaggagaaaaacggaaaaacggaaaaacggcgggggtactatgaattaaagaataaaagattgatcagattatttgaagagaaaccgcatcatatcccacacctgtcactacataatgaggttatgcttcatttttatatgtatataattatgaaaaaagactctgtctgtttgcttaccagatgttagcatgtatttttctacaacattgtttggagcgtttcctagagtactgcttggctttttgttcaggagccttgctgcagctgggtccttccttgcagccttcccaccctgctgactgacaggatgctacctttattgctgctgatgtttatcagactgatactctgcctctaattgcaactggcattgtctctccagctcacaggaggggaaactgttcttgtaattcttcgtaatacagttgaggcccggctaggaccttggccaggcttgggagtcatagggtttgcaaactcaaatgtcaacagaagtctggctggtaatggaagcgtgaaggctgcatagtttaagaaatgtgggcatgccatttggctttaatgttaggaaataacagccagtggccaggcgcagtggctcacgactgtaaccccagcgttttgggaggccgagatgggcggatcacgaagtcaggagatcgagatcatcctggctaacatggtgaaaccccgtctctactaaaaatacaaaaaaattagctgggcatggtggcaggcacctgtagtcccagctactcgggaggctgaggcaggagaatggcgtggacccgggaggcggagcttgcagtgagctgagatcacgccactgcactccagcctaggcgacagagcgaggctccgtctcaaaaaaaaaaaaaaaaaaaagaaaagaaaagaaaagaaaagaaataacagccagtatgagtgaactgacgacgacatactgcatttaaagggagaagctgctattcaaagccaactgattgttgatatatggaaacagggcttagtttttccagttacgattttgcaaaagaactctgcaatttatattttttaagggaaatattcttatttttcaatactggcaactaattctttttttttttttaaagaaagtgctgtggccaaaccaaatatttctgtgggcctccatagaactatgaaacactaatctatgaccattgactaacaactgctaccggaagtagttacttgctactcccaggactcacagtccaactatcttttagattccctgcatagcaaccggcagacctccatgtagcatgagctgacacagacagacatacagacatacacacacacacatgcacacgcacatttacagagtgcatatgaatgaaaatcccatttatatcaggagaaaaacccacatcctccccaatattggtgttgggctccacagactactcaaagccatcactgtggtttgcccatttagtctcaagtaacactttatgtggaagagaaatgttacattatagtccatatgccactgcgtcaaatccaatgcactttgcattcaatcttgccttcaggatgaggtaaagaaaagttgctactgtatgcatggcataatctcatctcctatctcctggaagcaaatggttaaacaaaaattataaacacaacttccaagaacaaaatagtaattttcagtagcaagtagcctgaattcagatttaagataaactatgtctaactctgtggaggttcagcctggctaataaatcaaatttacattaaggtcagggctctggtgggactattcccttatattcaggagtgtcttcaagaataatggaaagctacttgagtacaagagtaaaagggcccactcaatttccacatcagaatgcgggaaaaccacatgccatattctcattggaaacttctcctgcttcaaaatttaaagttcattctgcaccagataatccatttgattaaaagaaaacaacttctgagggctaacctgttaaataagcccacatccaaagtcatcttaaaggtgactatcagagcaataaaatgaaacagtaaccctgcttgaaggcaaaacaaatttgaagaacaattcagccagaggtagagtcttgaagtctaacaccagctgtaagaaatgaacactatgctggagaagaggtgagagatcaggctaccttgtttttgagtaacctagcatgtagatatctattgtgcaggaagatgtatcaggtaccttggaattacagaactaatgtctatggtgctgaatttatgctaagaaatattctgataatttaattttcccattaagaaaaagtttgctggtcaacctgaaaaatatggtctatttggccagattgacaatatttctcattataaattaacaaataagttttctggttatatactttagttacacaaatatattgtgtaattgtatgatatgattacattgagagggtctaaatattttatatacttaagaaatattaggtaagttgattttaaataggcattacagatggcaacataagtaaattaaaatatcaccttatacagtcaactcatttttaacttttctttattcatgcactggaaacatgcatttttatttttatttctcaaactattttttaagattaaatgaattcatttttctttacctgcagaaaattgccctgtcattaagaaagaggaagaagagaacactcatatttattgacagcattgtttggcctcttatatatataaaatgtcatttattttgcacaataaccctggggaaaaaaggtattctccctgtgtaataaaaataggttgaggcatgtttagtaaaacatgccctaggtcacacagctagtaaattgtgggctaagatgactcttttattctttatgatttttttattggcacattgtagcctaaaattctaaaagaacatataatcttgtgtgctactaaaaattttaatctgctctacccaaggtttaagtagtatttgaatgagccagattgggagaggccgtgactcagtcagagtcagactgtcagacttgcagtgttgtttggaaagatgggtttctgagatgcgcattaggccagggacatcaggcttcaagtaaatctaaaatctaggagattattctttgtagggtagaggagacgcaaaggacataggtttaaaataagcatattaacctgtgcagctgcattaatgagtgcggcttcaaaagaatctcttcagtaacagagaaaataatgactatattcatacatagtaggccattgacagaagacccaggaataagatcagccatatattgtatctgaaatatggctaaagtgtaattaaatatttaatattaaactaaactcatatagaactgggaaataagaccatcaaattctcagttattgttatctctgaaagtggctttgtttagttgataatttgactagggttagaattataggtccaaatatatacatatatatatatacacacacacacgtatatatatatatatatatataccgtatatatatatatatatatatatatatatatatatacactttttttccaactcaatattttgctcaagtgtttaattgcaagtagtatgctgatgaaaaatctgttgttaatcttgttcttattttcctgtaaggaatctttcttttctctctagcagtgtcagaaatttcctttttatacttagtattctaagatttcaccatcttgtacctgtctttttaattttgcatggctttcactgacccattatgtagtttcatgtctttataaagttctggaaaattttaggctattacctcctgaaatattttttccctacattctgtctaaatctattgaaaagagttacgagtgggtaggtaatttggtgactggtctcttggtatgagagcatctcattccttttggtgtcaccaattctctaatacactgccctatttctctgcaataagaactgtattcatctttcctttgtggagatagatattgctatttgtcttataggagggagaggagagagatactcaggggctgacctgtctgggttctccctttgtggggctccaactaatcatcctgccaatggcttttgggtacccctcctgctcctggatttcattccttccaggcgtggagcatttatcttgttggtctcacctcctgggttagaacttttctgaaggaatcatgggctgtgacctctttcttttctgctcatatttttcaaagactaattattatttctgtcgttttcaccatagatatttttatttatttaaaaaataaattttccttaatttttatgaatttagtgtaagaggagggattatattaaatgctcaccattttaaaattagaagtctgtcttctatctttccttcactaatatgtgtgttttgtacttagtcatatggtcaaatacttgtacataaaattatctgaaaaagcaaatgaaaaattaactagatttccccgtcgtatttgcatgtattccttacaaacttacctcagtcttcattttttcctgctctgtccattttcatccaaaacatacacatatacatcatacagtcaagataagcatgcatatatcacaggtatctttaacacagtttgaagatgtaacccttcattaaatgatgatggagaaaaaataaaggtaaacttagagggtatagttgagagacagtattaaaacaattgacttttaaccttattggtcttgattatggaacagagatgggtgaatcgttcatttagatttttttttttttttttgagacagagtttcactcttgttgcccaggctggagtgcaatggcacaatctcagctcactgcaacctccgcctccctggttcaagtgattatcttacctcagcctcctgagtagctgggattacaggcatgcaccaccacgcccaactaatttttgtatttttagtagggacggggtttcaccatgttggccaggatggtctcaatctcttgacctcgtgatccacctgccttggcctcccaaagttctgggattacaggtgtgagccactgcacctggcctcatttagattttatgttatttatttatagcttgataatattttgtcttttaatttttattattgtctaaatattcagatttagaggaaatattattttcttcaggcaaaataacagtcctgagaggcaaagtttttttgcttcttttttttgagatgcagtttcactcttgtcatccaggctggagtgcaacggtgcgatctcggctcactgcaacctttacctcctggattcaagcgattctcctacctaggctcccaagtagctgggactacaggcacacaccaccatgcctggctaatgttttgttttgtttttttttttagtagagatggggttcgagaccatgttggccaggctggtctcgaactcctgacctcaggtgatccacccgcctcagcctcccaaagtgctgggattacaggcatgagccgccacacccagcctgcttttaaaaatattatttttaagttattagtagaatggacttattgaaatatgtattttttaactgaaggtacttggcatagtaagtttaactatgtttaactctgttgatttgcttttacattttgtgcaatcataagtgtccttcagttcttaaatatccacagcaaatcaaatattaactctgtgcatgtttttgagtttttattaagtagtgtttatatcattgtacctattcttatagctattgcctacatccaagtaggcattttgtttagttctttttctttagtctctcgaaataatgaaaagtgaaaatttctatcatttgattgactgttttaagtctttaagtatattacactttgggcaaaatgcctactactgataaagacagcaaagtttttacagatgtataattaaaaactgacaatgcagtataatggagaacacacagaaagttccctttgtagtagtaaaaatgttggtatgcatagaggtgggaacttcaatgtgctagtgtggagggagtggtgtggaagtggtatgccataagtgtggaaaggtaggtaggaaccggatctttcctggccttataggttataataaggatattagatctttttctcaagccaataaggaattttaaaataactttaaagaggggaatggcatgattagtctatagttttaaaaagtcactctgccttcattatgggaaatacattgggggcagagggtatacaaatgcacatagggaggaggatgtgcattgaaacatatacatttgtgggcacaaaataaatattttgggatattggcagattggctaactctattctcttcagacttcttttcaatattttctgaaacgtcaccatggacaaataataattaataattaataattcattaattaatcattaatacaggaggttccaagatggccgaataggaacagctccagactgcagctcccagaagatgggttatttctgcattttcaactgaggtaccaggttcatctcaatggggcttgtcagacagcgggtgcagcccagggtgcagggcggggcatcgcctcacccaggaagcgcaaggggtcagggaattccccttcctagcaaagagaagccatgacagacagtacctggaaaatcaggacactcccaccctaatactgtgcttttccaatggccttggcaaacagcacaccaggagattatatcctgcacctggcttggagggtcccttgctcactgctagcacagcagtctgagatcaaactgcaaggcggcagcaaggctgggggaggggcgtccgccattgctgaagcttgagtaggtaaacaaagcggccgggaagctcgaactgggtggagcctaccacagctcaaggaggcctgcctgcctctgtatactctacctctgcgggcagggcatagctgaacaaaaggcagcagaaacttctgcagacttaaatgtccctatctgacagttttgaagagagtagtgcttctcccagcatggagtttgagatctgagaatggacagactgcctcctcaaatgggtccccgacctccaagtagcctaactgggagactcctcccagtatgggctgactgacacctcatacagccaggtatccctctgagatgaagcttccagaggaaggatcaggcagcaacatttgccattctgcaatatttgctgttctgcagcctctgctgggatacccaggcaaacagggtctggaatggacctccagcaaattccaacagacctgcagctgagggtcctgactgttagaaggaaaactaacaaacagaaaggacatccacaccaaaaccccatctgtaggtcaccatgatcaaagaccaaaggtagataaagccacaaagatggggagaaaccagagcagaaaagctgaaaattctaaaaatcagagcacctcttctccaaaggaatgcagctcctcaccagcaatagaataaaactggatggagaatgactttgacgagttgaaagaagacggcttcagacgattggtaataacaaacttctccaagctacaggaggatgttcaaacccattgcaaagaagctaaaaaccttgaaaaaagactagacaaatggctaactagaataaacagtgtagagaagtccttaaaggacctgatggagctgaaaaccatggcacgagaagtatgtgacgcatgcacaagcttcagtagccgattcgatcaactggaagaaggggtatcagtgattgaagatcaaatgaatgaaatgcagtgagaagagaagtttagagaaaaaagagtaaaaagaaatgaacaaagcctccaagaaatatgggattatgtgaaaagaccaaatctacgtctgaatggtgtacctgaaagtgacggggagaatggaaccaagttggaaaacactctgcaggatattatccaggagaatttccccaacctagcaaggcaagccaacattcaaattcaggaaatacagagaatgtcacagagatactcctcaagaagagcaactccaagacacataattgtcagattcaccaaaatagaaatgaaggaaaaaatgttaagggcaggcagagagaaagattgggttacccacaaagggaagcccatcagactaacagcggatctctcagcagaatctctataagccagaagagagtgggggccaatattcaacattcttaaagaaaagaattttcagcctagaatttcatatccagccaaactaagcttcgtaagtggaatggcacaatctcatgcgccaaacaaatgctgacagattttgtcaccaccaggcctgccttgcaagagctcctgcaggaagcactaaacatggaaaggaacaactggtaccagtcactgcaaaaacatgccaaattgtaaagaccattgaggctaggaagaaactgcatcaactaacaagcaaaataaccagctaacatcatgacaggatccaattcacacataacaatattaaccttaaatgtaaatgggctaaatgctccaatgaaaagacacagactggcaaattggataaagagtcaagacccatcagtgttctgtattcagtaaacccatctcacatgcagagacacacataggctcaaaataaaaggatggaggaagatctgccaagcaaatggaaaacaaaaaaaggcaggggttgcaatcctagtctctgataaaacagactttaaaccaacaaagatcaaaagagacaaagaaggccattacgtattggtaaagggatcaattcaacaagaagagctaactatcctaaatatatatgcacccaatataggagcacccagattcacaaagcaagtccttagagaactacaaagagacttagactcccacacaataataaagggagactttaacactccactgtcaacattagacagatcgagacagaaagttaacaaggatatccaggaattgaactcagctctgcaccaagcagacctaatagacatctacagaattctccaccccaaatcaacagaatatacattcttctcagcaccacatcccacttattccaaaactgatcacatagttggaagtaaagcactccttagcaaatgtaaaagaacagaaattataacaaactgtctctcagaccacagttcaatcaaactagaactcaggattaagaaactcactcaaaaccgctcaactgcacggaaactgaacaacctgctcctgaatgactactgggtacataacgaaatgaaggcagaaataaagatgttctttgaaaccagtgagaacaaagacacaacataccagaatctctgggacacatttaaagcagtgtgtagagggaaatttatagcactaaatgcccataagagaaagcaggaaagatccaaaattgacaccctaacatcacagttaaaagaactagaaaagcaagagcaaacatattcaaaagttagcagaaggcaagaaataactaagatcagagcagaactgaaggagctagagacacaaaaaaacccttcaaaaaatcaatgaatccaggagctggttttttgagaagatcaacaaaattgatagactgctagtaagattaataaagaagaaaggggagaagaatcaaatagatgcaataaaaaatgagaaagaggatatcaccaccaatcccacagaaatacaaactaccatcagagaatactataaacacctctatgcaaataaactagaaaatctggaagaaatgtataagttcctggacacatacgccctcccaagactaaaccagtaacaagttgaatccctgaatacaccaataaaaggctctgaaattgaggcaataattaatagcttaccaaccaagaaaaatccaggaccacatggattcacagccaaattctaccagaggtacaaagaggagatggtactattccttctgaaactttcccaatcaatagaaaaagagggaatcctccctaattcattttatgaggccaacatcatcctgataccaaagcctggcagagacacaacaaaaaaagagaattttagaccaatatccctgatgaacatcgatgcaaaaatcctcaataaaatactggcaaacccaatccagcagcacatcaaaaagcttatccaccatgatcaagtgggcttcatccctgggatgcaaggctggttcaacataagcaaatcaataaatgtaatccatcatattaacagaaccaaagacaacaaccacatgattatctcaatagatgcagaaaaggcctttgacaaaattcaacagcccttcatgctaaaaactctcaataaactaggtattgatgacaagtatctcaaaataataagagctatttatgacaaatccacagccactatcacactgaatgggcaaaaactggaagcattccctttgaaaatcagcacaagacagggatgcctccctcaccactcctattaaacatatcattggaagttctggccagggcaatcaggcaagagaaagaaataaagagtattcaattagacaaagaggaagtcaaattgtccctgtttgcagatgacatgatcatatatttagaaaaccccatcatctcagcccaaaatctctttaagcgataagcaacttcagcaaattctcgggttacaaattcaatgtgcaaaaatcacaaggattcctatacaccaataatagacaaacagagaggcaagtcatgagtgaactcccattcacaattgcttcaaagacaataaaataccaaggaatccaacttacaagggatgtgaaggacctcttcaaggagaactacaaaccactgttcaacgaaataaaagaggacacaaacaaatggaagaaaattccatgctcatggataggaagaatcaatattttgaaaatggccatactgcccaaggtaatttatagattcaatgccatccccatcaagctaccaatgactttcttcacagaattggaaaaacctactttaaagttcatgtggaaccaaaaaagagcccacattgccaagtcagtcctaagccaaaagaacaaagctggaggcatcatactacctgacttcaaactatactacaaggctacagtaaccaaaacagcatggtactggtaccaaaacagagatatagaccaatggaacagaatagagcccccggaaataataccacacatctagaaccatctgatctttgacaaacctgacaaaaacaagaaatggggaagggattccctatttaataaatggtgctgggaaaactggctagccatatgtagaaagctgaaactggatcccttccttatactttatacaaaaattaattcaagatggattaaagacttaaatgttagacctaaaaccataaaaaccctagaagaaaacctaggcaataccattcaggacataggcatgggcaatgacttcatgattaaagcaccaaaagcaagggcaacaaaagccaaaattgacaaatgggatctaattaaactaaagggcttctgcacagcaaaagaaactaccatcagagtgaacaggcaacctacagaatgggaggaaatttttgcaatctacccatctgacaaagggctaatatccagaatctacaaagaacttaaacaaatttacaagaaaaaaaacaactccatcaaaaaatgggcaaaggatatgaacagacaattctcaaaagaagacatttatgcagccaacggacacatgaaaaagtgctcatcgtcactggccatcagagaaatggaaatcaaaaccacaatgagataccatctcacaccagttagaacagcgatcattaaaaagtcaagaaacaagaggtgctggagaggatgtggagaaataggaatgcttttacactattggtgggagtgtaaactagttcagtcattgtggaagacagtgtggtgattcctcagggatctagaactagaaataccatttgacccagccatcccattactgggcatatacgtaaaggaatataaatcatgctgctataaggacacatgcacaagtttgtttattatggcactattcacaatagcaaagacttggaaccaacccaaatgtccatcaatgatagactggattaagaaaatgtggcacatatacagcatggaatactatgcagccataaaaaaggatgagttcatgtcctttgtaggtacacggatgaagctggaaaccatcattctgagcaaactatcgcaaggagagaaaaccaaacaccgcatgttctcactcataggtgggaattgaacaatgagaacagctggacacagggcggggagcatcacacattggggcctgtcgtggggttggggaagcagggagggatagcattaggagagatacctaatgtaaacgatgaattaacaggtgcagcacaccaacatggcacttgtatacatatgtaacaacctgcccgttgtgcaaatgtaccctagaacttaaagtataaaaaaaaaaaaaagaacaagaactccaataacaggccttgaaaaactaagcgtgaaatccaggttgtggaacgtttgaccccaggaagaatgtatttcatctgtgtgtagttcatctgtattcttgtggtaatcaagcagacaccagctagaccactagttggcccactgctcaagacagtcgtcaagaccagacatactaccgcacacgtagtcaactcctgtgcttcccataaaaaccgtctagctagcctgagaaacttgagatgatctttgtgacatgagtccaccatctcctctggttgtcaactcctgaataaacccatttttctccctcaaaaaacattaataattattaataataaattaacaataaatcattaacaataattaataattaataataattaataataaaaattaataaaaataaaataaaataaaagtattaaaaactctaataaaatataatacaatataatatataatacaatacaacataatatgtgttatggctaaggaaatttcagattaggaaggacacctaatttagactaaaagagaacagcttcctagagaaggtgaaagatgagttaagtgctgatagctggatagttcagtcagaccaagaaagaatggcttttctgaatcaaagaagaacatttatgtggatatcctgataaaacggaaaacagatcagagtacaaagtataccattaccagggatgtggctgaagagataggccgacaagatattagatattatgctaaaaatccaggatttatcctgaaatggtaaatggtaattgaaagatttttagcaagacagtgacatgatgaaactggtatttcaaaatgaacatgctagcaagaggtgggataatgtactggatgagaataagacgggaagcagagaggcccattaggaatttgattcatttattcactaatggtgataccaaatgcttagtatgtaacaactattgagccaggtgttagggacacagtggtcaacaaaaaagagggccactgctttccttcaaaggtttaaagtctagcacatcaataaaataatacagggaggtaatccagcgcttgaccattctctccctttaaaaattatgtgtgttactttattataatttaaaaatacagatgaataagaagaatgtgaacaaaatcagacatccactcaacctctatggaatgttaacattttattgtgtgtacatacttctagatgtttaaaaatatagtatgtgtatatattgtatatcatacaattatatgaataaatcagactgttctcaattggtttatgatctagtttcctcttaacaacacatggtgatctttccataaccataaatctatttatccatattattttttatgaggggatgatgttctactgcattttcggacattttaggtaggactattcaaaacaatgttagaatgaatattcttataggcaagttttaaatttcatttcattagattaaattcttagaagtggaataaaagaaaatgcacattttaaaggcctttgataatgccccaaaccctcctttataatcttttcttctggcttccataccatactttgttaggttttttttttttttttaactacatcagcaactcatacacagtcttcttcattagttcattgctgcacattgaaatcatctggggatttttaaaaattactgatgcctggctcccacccttagacataccaatttcattggtatgtggtacaatctgggaattggaatttttagaagtgcctcaagtgattcttacttgcagcaaaagatagaaaccactgtattcttttattttccctgtttactacagaaatttaagttccatcctagatctgcatcttaccttttttcacatgctcttcatatgtaatcataatttcacctcttccactctaaactctatgaatataattaaaaactcgtatcttgcacttttcctgaggtccagttccactttgttcattgcctataggaaagtgtgcactaatgctaaatatagaattagctctcaaacttggtgtatctcaaactgaattaagaggtctcccttactcttgataaacagaaaactaaacacatgtttaaaaaaacagcaacacctgtggggaaagatattttctacctttcagttggttgcaaagctcttgtcttgattctttctctaaaacatattttaaatcagtttcccctaccctttctattaccattaccacaacctctaccctcagagtagtaccactgtgacaatacttatctgaatatctgtcttgggagcactggcctgtcagagtagtttgcctgcaatctcacttgcatgaagatagcacctagtgaataccagtagatatgacattagggactgaaatcaaggtggaattaaaaatttcaacacatgtaagtaagagtgtgtgtgtgtgggaggaagtgggataatgtaggagaagggacagtgatcatttccaactacttgaagatggccactcttgggccaggaactcagcccagggttggagaatgttgagatacatcgggctcatcccgattgatttcaggctgcaaaggtcactttgagaattaattgacccaataatggaggaacaactataacgttccaggagaaagaaggctaaaaagcaaaactattttatttgtgttataaatatctgaatttttaaaaaatttgaactccttacccaggcaagtctgccataatttcaaccaaggaatactgacaaatctagaaattgagagatttataagctactgaatctaaaatatggaagcagctaagctgacatgactggggaaagtgaggatcctttaatctctgactgtgagggtgactgtccttgacatgctgtgaagagtagctataaaccatcacttcttgtttctcagatctcaaactattgatccactcagctaaaataaaagctccattgagcagaggccttgattgtacaattaattattctccagcagctctgagagtgtgagatatatggtagccatacaaaaaatattgagttaataatttctcatactggggccaaaacccctgtgaccatagtagcaatgtagtagggtgttcaagtgtgttacttctttagaattttagaaatgtaatttaagaattttttttttttttttttttgagactgaatctcactttgtttcccaggctggagtgcggtggctcgattctggctcactgcaacctccgtctcctgggttcaagtgatttgcctgcctcagcctcccgagtagttgggattacaggcgtgcgccaccatgcccagctaattttgtatatttagtagagatggggtttcacatgttagccaggctgatctctaactgctgacctctggtgatctgcccgcctcagtctcccaaagtgctgggattaacaggcgtgagccaccactcctggcctaagatcattttaataagatttaagagacactaatttctgtctttcaagagaggtactaatttccatctaagcaggcccaccagaaagtagatatggaaaaacaggacaagcatataatatttgtaaagcaaagcattttatttctagaggaagatttgaaatccatggaagttaggagataacacagttgttttagttatttgtcacactttaaagtcattgtagcagttaggaaatagtgagatcttggcaaacaaaatgtggacatctaggagaagccaaagagttggcaacactttttaagcatctctggcagctcctgtctagttggactaaaggaataccatatcctattataaatcacatttccctggaactcagcttaaagggcaaactttagaaggaaaacctccatcatcctcattcaatacttcagctactgtttcttatccgcatctaaacaaaggccattaaatagagtttcagggaaaggcagagctgccaggaatgatgcagagatggcctttttctttagtaaaccagaagcttaaatgggcatgactccataagattttttgttttagtaattagcaaatagagtttcaaattcaaattgacttgaagcaagcagaagttttaaattaattaaattttccaggaaagggaagcctagccctaggaacagagattactcaacttgtaatgcattcctcaggcctaagtatccacacctataaagaatgacttggacttgcaaaggtaatagagctacttaagaagaatctctccaacatccctctgagaagcagcccagaaagatacaaggcaagggaaatctttccagggagaagaactcaaggtgctgaatggcttttaaaggacatttctgagccgggtgtgttggctcatgcctgtaatcctagcactttgagaggtcaaagcgggtggatagcttgagtccagtggtttgagaccagactggtgagcatggggaaatcccacctctacaaaaaatacaaaaattagctgggtgtagtggcacacacctgtagtcctagctacttgggggctgaggctggaggatcgcttgattctaggaggttgagggtgcagtgacctgaggttgtgccactgcacttcagccttggcagtagagtgagaccttgtctcaacaaaacaaaacaaaacaaaacaaacaaaacaaaacaaaacaaaacagcaaagacactttctctatttccaagggagcaagtcaagaacattttatactgcctgctcctaacaagtgattattctcaagcccctttctttcccctaaatgagataattttattaaggtaattctgtctgtggtgcacctttatttgcccctctgaatccttctccacgctccaccttcctctacctgcaatgctatcctgggaggctgacctgcatgaaaaaccttaaaggattcttacctcctctggcttccagttgggttcagccaatggcacagcagtagataagaaggaggtggggcgggcgcggtggctcaagcctgtaatcccagcactttgggaggccaaggcgggcggatcacgaggtcaggagatcgagaccatcctggctaacatggtgaaaccccgtctctactaaaaatacaaaaaaaaaattagccgggcgtggtggcgggcgcctgtagtcccagctactagggaggctgaggcactagaatggagtgaacccgggaggcagagcttgcagtgagccgagatcgcgccactgcactccagcctgggcgacagagcgagactctatctccaaaaaaaaaaaaaaaaaaaaaaaaagaaggaggtgggaggctaggagctaggataagggtacttatcttaagcctccgttcctgtgtccctcagctgaaggtcactgctcatttcaggccaaatggcttcatgggactctccctcctttagtaaccgctggccgaggggcaatagctcagctactacaaaaccccgagctcttgaattataaatcagaattaccctacgtccacacttaatttccttcttgaaatctactctctacatagacaagtgaattttcccctccctgaccaaatcaggcctccaaatataagcttttgtagcttgcttaaattcttgattaatttttactattaaatgattagtttgaattctcccttcctctcacagaatgtaagtttcacgagagcagaaagtgcattagtgttgttctcagctgtttgctcaaggtttaaataaaaacttaaacatagaaacaaaaatttttctttttagttgtgctttctattttttcttgggaccctgatagacagaacagtgaaattcatcatctaactgaagattgcagtattttggaacttggcattaaaagcctgactcaattacactgaaggagattgtacatctcacagaaagcttggacttgagcactgacctccagacactacctgagaaggtctagtagacatgattttccattggagaggtggtggtgtttttgatggcatgtagattgtgactggcaggggcatttttggaatgtaagcatgtctttgagtatgtgctaggtaaaattgaagagtagattgtagtgagcctccactgtggttctgctttatgccaataatttttcttttaattttctattcataaaataatctgcattaggacttttgccaattcagcagaattatgtcattaatacaaaggattataatagaacataaattggctggcccatgcatgaaatccaaaataatatgagtattcacaattttgacaaagcattcaccttaagaagaggcaaacaagcagggaactaatacagatacagttaggtttggtagaacactgatacttgtgatatttatgacataatcatggttctttttgtcataatatggtattttatatagctatttacttaagtgactatatgcatatgaactactaacatttttcacattttctctgcccatatttgggctgctcaataacagatagaaatgttatagttaaaaagaaaattattggccaggtgcggtggctcatgcctgtaatcccagcactttgggaggccgaggcgggcggatcacgaggtcaggagattgagaccatcctggctaacactgtgaagccccgtcttactaaaaatccaaaaaattagccaggcgtggaaggacatgcctgtaatcccagctacttgggaagctgaggcaggagaatcgcttgaacctgggaggcggaggttgcagtgagccaagatcgcaccactgcactccagcctggatgacagagtgagactccgtctcaaattaaaaaaaaaataaaaaagaaaattattatctggctgggtgtagtggctcaacctgtaatcccagaactttgggggctgaaggggtggatcacctgaggtcgggagtttgagacaagcctgaccaacatggtgaaaccccgtctctactaaaaatacaaaaaaattactgggcgtggtggcaggtgcctgtaatcccatctattcgggcagctgaggcaggagaatcacttgaacctgggaggcaggggttaccataagctgagattgcgccattgcactccagcctgggtgacaagagcgaaactccatctcaacaacaacaaaaaaaaaaaaaaaagaaagaagaaaaaaagaaaattgttacctattctccttagataaccctaatcttaatctagtaatactgtatcctttttgagaagatttcagctgtatcctttttgagaagattcagctaaaggttaattcagctaaaggttaacttcagctaaaggttaattggttaacgtgacatattacgcttaaaaatccctaaatgagtcgttttaaaaacctgtctttccctctaatagccagagtttctttgtgctattgtgttaccttctgattcatccgagtgatgcttgagaatgccaggaaaacaataaaaacatttcttgccactgagccctacctttgcctggaactcagtgaacatcctccatgaggtggcaaaattgttctggtattagtttgtagtaaaatttcctgaattaggagtggaaaggaagacaatattatgtaaaactttccgtgggttcacaaaaatgaagtgttatcttgtgttcagatcccagacttagagaaaatgattgtgttttctttttcttttctttttttttttttttgagacagagttttgttcttgttgcccaggctggagtgcaatggcgcaatctcggctcaccgcaacttccgcctcccaggtttaagcgattctcctgcctcagccccctgagtagctgggattacaggtgtgagccaccatgcccggttaattttgtatttttagtagagacggggtttctctacgttggtcaggctggtctcgaactcccaacctcgggtgatccgcccgcctcggcctcccaaagtgctgggattacaggcataagccaccatgccctgccaataaaatgattttgaacatatagttctatattatttatagtgaacatttaatggaggggaagttctgccttcaggaagactatgaatattgggactgtgtccttagtagacttggcactaaaaaaattcactcatttgacatcacaagattgcacaataaatattggagatgttggaaaggtacaggtacacaatggaatactacacattcgaaatgaagctgtagaattgaatttattgacaaagatgtttataatatatcatcattaagtgcacaaaaagggtaaactatatgctgaaggatagtttgggcagcaagcaaaagaacatctaattcaaaatgaattaaataaatatatttatttttataattatcataattacatttattaatctaattgttctagtgcagaggtaaaataggcttcagggtagactgattcagtgacccaacaatattattaaaaaacaatgttctttctgtctctctgctctgtaatccaaaatatctgctttatctcacagctagttcccccaaataattgtaagatagattccaggtgcaattggatattactacttgctttctcattcatatgctgaagaaagagagaatggcttgttattgctttctgcaaagaccaaagaggaaatttttgaagtctgtagccactatctcttcatttatcattggctagaactgctgatttctaaactgatagctggcggaaagaatgtgattatctttagaccagtcagactcacacattgagttaaaggcaatttctaaaatcagagtactgccatttcatggatagtagagtggaatgcatttggggatttggacacagttaaaaaaatctctatctaatctctctctatggatattctagaaaattaatattgtcatatgatagtatctggacaatgacttacatttctttttaattttcttcctttcactcacatgtatataatattcttctgtaaataagcatacattgttttttgtctctttaacattttagtatggaaaatttcaaataaatccaaaaataaagatagtaataaaatgaaacctcaagtatccatcacccagattcaacaattatcaacttctggaaaaccttgttttatgcactgtttgtaataagaaaaaaaaaagttgattttagttaaaaaagaagttaagatctgcttaacattttctcttgtccatagaatataccttaaagcaaatcagtaaagtttagctaaggatagcccaatatttttcctgtcaattgcccaagatctctcttaaattataccccaagtatttttttgaaaatttggtttttctcagtttcttatcctacatatgcatctcaaaaatttggaccgcagtaccccaacatcaggagaaaagcacaaaactctaggagcttgtgtatatgaaacaaagtggctcactaaaagcatagttattttgaaatctcatttttagttttaaagtctgtatttttttttttttactctatctaccaatgtttaatagaaataaaatatttcaaattactcaccattgaataaacttgacactgttggaagatggtccatgttggtcttttggcttcttgtcctctgaggcaccctgacaaatacccctgtgaacacaaggtccccaatttaagagtcatagattatagttttcttcccttttaagactccccttttgatctttgaccatatttccttgacttttaaacttcattctctttgaggactttgctttgaattcagtcctcttgttttttccattttagacctcctcagctcgtatgccctatcttaggattaatactcactttccagtcctggccaggcctggcccagtactctgcaagaggatcttggacctgtaagtcacaaatatcaaggtactcattcatttactaaatctttattgagtatcaaccatgtttctggcacttagctagtccctggggatactgtggttaaaaaggataaaatctcagtgtttaagaagactaaagacatcaggaacacaaaaaatatttaggcaattataaaatgggcaaataagtgctacattggatgaagtactgcatcctataaagcacaaagcagtatcctaagcagatgagggaagtcttccaggaatgagatgcagtataacaataggaaggaaaagtaagtggtggtaattttctatatttgaatgaaaacttactcttgctcaaccacgaaggatgttttcttagaaataaagggattgtcaaaagcagcattcagtatgggagcttacagtgatgtatctagaggggacaagcatgaagagtttgattactcgggagtgcagtttagaaaataactatgtttccttcacagaaaggaagtgttctgccaggcggagtcattgcttccttttctctcttcccttagtcctttgttttcttttttctcttgttttcttttctattttttctattttttttttttttttttgagatggagtctcactctgtaactcaggctggagtgcaatggtgcaatctctgctcactgcaacctctgcctcccaggctattctcctgcctcagcctcctaagtagctgagattacaggcacatgccaccacaccaagctaatttttgtattattaatagagacaggggttttaccatgttggccaggctggtctcgaactcctgacctcaggtgattcgcctgcctgggcctcccaaagtgctgagattacaggtgtgagccaccacgcctgggccagccctttgctgtcatatcacatgtggaacatccctacctgcctctcctatgccttcctacctgaagaaataaattaatcattttcccttctaatctacaaactgtgtattatactgaaacacaatgatactttaaaaaatttaagaattaaattgattcaaattttattttatttttagattcaactgattattttgattacttaatcattaaaaaatgatactgttcagtattcagaaagtttgggttcatttttttctttcttgtttctcaataaaagaaatgggtagtggtagtgatgttggcatttgttctgaaagataaatgtgacatgatactcatttcctgcctggcgcggtggctcacgcctataattgcagcactttgggaggctgaggcaggtggatcgcttgagcccaggaattcgagatcagcctgggcaacatagcaagaccgcatccctaaaaaaggagtacaaaaaaaaattagccagtctcataacttggcctgaaaataaataaataaataaataaataaatagactcatttcccattgagtaatccagaaagagacacaccctgaatggtattgcctaggttttcttctagggtttttatggttttaggtctaacatttaagtctttaatccatcttgaattaatttttgtataaagtataaggaagggatccagtttcagctttctacatttggctagccagttttcccagcaccatttattaaatagggaatcctttccccatttcttgtttttgtcaggtttgtcaaagatcagatggttgtagatgtgtggtattatttctgagggctctgctctgttccactggttataggaattggcaaggacttcatgactaaaacaccaaaagcaatggcaacaaaagccaaaattgacaaatgggatctaattaaactgaagggcttctgcacagcaaaagaaactaccatcagagtgaacaggcaacctacagaatgggaggaaatttttgcaatctacccatctgacaaagggctaatatccagaatctacaaagaacttaaacaaatttacaagaaaaaaatcaaacaactccatcaaaaaatgggcaaaggatatgaacagacaattctcaaaagaacacatttatgcagccaacagacacatgaaaaagtgctcatcatcactggccatcagagaaatgcaaatcaaaaccacaatgcgataccatctcacaccagttagaatggcaatcattaaaaagtcaggaaacaacaggtgctggagaggatgtggagaaataggaatgcttttacactattggtgggagtgtaaactagttcagtcattgtggaagacagtgtggtgattcctcagggatctagaactagaaataccatttgacccagccatcccattactgggcatatacgtaaaggagtataaatcatgctgctataaggacacatgcacatgtatgtttattgtggcactattcacaatagcaaagacttggaaccaacccaaatgtccatcagtgatagactggattaagaaaatgtggcacatatacagcatggaatactatgcagccataaaaaaggatgagtttatgtcctttgtagggacatggatgaagctggaaaccatcattctgagcaaactatcacaaggacagaaaaccaaacaccgcatgttctcactcataggtgggaattgagtaatgagaacacatggacccagggtggggaacatcacacaccagggcctgtcatggggtagagggagggaggagggatagcattaggagatctacctaatgtaaatgacgagttaatgggtgcagcacaccaacatggcacgtgtatacatatgtaacaaacctgcatgttgtgtgcatgtaccctagtacttaaagtataataaaaaaataaaaataaataaaaaaaagaaagagacacacccaaccattattgaagtcctctaaggtggggatagaggacacacagttcatcagggctgaggaatagagaatgggaaaacagatgaagaaaggcctgtgctgaccttttccatgccctcccatggatgtgtttttcctgcacgtcaagttatttaagcaaaggattgtttttgtctggatttttttcttttccaacttcagccatttcttttgttctttttaggcatgaaacattaaataaagttattcttaatatgggatattctcccctaagtctttttagatgataaggaaacagcatgtccattccaatagcctgttcaagagttctacttttaataatttgtgtctcatacttccagatagtccacacatagggcaggtcttattatttcttgtgtatttcattataaccttattaggcccaaacaaaataagagtcacgaataggcaggaaaacatatgactgtagtaagctaggtgttgaacaggaaactgtggcttccagagattaaaatagttttgtttttgatcttagaggaaacccaaaaggtgttcacttaggtctggttttaaacaggcagaacaacatattttaaagtaatatttctggtaattctgcagctactttgtagtgcctctgctgttctaggcattgtgctagatggtatgaggaattaaagatgaataagaacaaagtttccttcttaggagggaatacaatctaagttagcttttctctttatttatttatttatttttctgagatggagtctcactctttcgcccaggccggactgcagtggcactatctcagctcactgcaagctccgcctcctgggttcatgccattctcctgcctcagcctccccagtagctgggactacaggtgcccgccactgcacccggctaatttttttgtatttttagtagagacggggtttcaccgtgttagccaggatggtctcgatctgctgacgtcgtgatccacccacctcggcctcccaaagcgctgggattacaggtgtgagccaccgcgcccagcctgcttttctttattgtaaccaaaatcatttgatgacttccaaacagggcaacatatgtgtcaaatatggtcatatttaaataactatgccaaggttctgcagttcaattaacttcatttaatttggacacttctagtattagaaaaatatctttttttgctatcatccattaaatcatcaatatttttaaagattcacttccatctctctttttaagaatgaggtgttacataaaactataggtaaatgaatttgaaaaagaaagcaagtaaggctgagtgcagtggcttaatgctgtaatcttagctctttgggaggccgaggcaggtggatcacttgaggtcaggagttcgagaccagcctggccaacatggtgaaaatccaactctactaaaaatacaaaaaattgggtgtgttggcatgcaccagtaatcccaattacttgggaggctgaggcaggagaattgcttgaactcaggaggtggaggttacagtaagctgagattgtgccactgtactgcgccactgcactccagcctgggtgacagagcaagactctgcacccccaaccccccaaaaaaagcaaacaagcaagtgcaagtaagactttgtatctctgattagatgttgaacagtgaatgtctcttcccagacaatttagataatttacatacattctttctctggttagccttacagattaaaaaatggtggctttttaagttttaagttgagtgacttatcaaaaatactttaagacttgaagaccaccagtctagaagttagagatgaaatattagaatatggcagtaaacagtccagcctatgaactagaactagattgactgggttcaaatctcagcttagccacctactagtatgagacttgggttaagttaaaaaagcccttgtatctcagttctcttatttttaaaatgctgataacaataatgtttgtaagatgttgtgggcattaaatcaataaatatatgtgaagtgcttgaaaaaaggtatggcataggcaaacactccatagagtgtcacctattatcatttttatgtgagtgtgggacctgctatccaatgacatcagtagtctcccactgtgacataaaaggattgcatacaaagaaatgcttaataaataattcattcgttcaaacaagtatttttgagagcctaaattctagattctggggatagagccaaggaggacaagctgaagttctcagttttaagtgactttcatctgaatgaagtaaactgacaataaacaagaggaacaaatatacataaacatattaagcattactacctactttgaagaaaaagaaagcaggctaaagggatagagactaataaggaataataatgggcaagctgttatagatggggagatttacactcttttgaggagatgatatttgagcagagatatgaatgaaatgagagtgaatgctgggaaaatcaacaggaaatgaattctagaaagtgggaacagcagaataaaggccaggaggcagaactgaattcaggggttcaagagtaaacagaaggcccatcgtggcgtgaagtaagatctagtattcgaagatgaggtagaagtagtcaaataattttggatgaataatagatacatttaatgactcaatcaaaatgatgagacatcatgctgaaaggaagcttaagatacatttgtaaataagattataagatgttgagtgggactttttttgttgcccataattgaaaataagaagagctaagtaaccccctttctatgagaagctcctaatagatgccaaatattgaggccagacactgtccccacctactaaagggtatgttacgaggcgaaaaaaattctctcctaccagcaactagcacctagctctggatacgcataaagagaaaactggagagagaacagtgcaagtcagcagacagtgctcacagggaaaggttactcctcttctcaaggggaacagaaggattattatttttttcttgctgaagccaattaatgggagtccatcagagaatgtttagagattgtgtgcgagtttgtgggaaggaagactggcaattcatttctcagctggctggatggtaatttactaaacacaccagtccctctggagctactatggcggagcgggggcgaatgtctccgcggagttgtgtatttgctacctgaagtttaggactcacccctgaatccaaaacagctgctagtcttaacatttctgaaggagaggaaattgctggagtagcttatggtaacagagttagaaggaactgtggttcagagtttgttcttgagaggggttaaattccctcctttatccccatcctggtcttttgtggcccttggagcatttagaagatggtctcagaggttactatggctcaatgcaaaacagcatggtggtaaggaagggagcagaatagctggtagtgaggagacactccagctggggaagcagttaggggcatggtctgctgtcagggtccaggcttttctctgagggattcctcagtgagtgagggggcaaagcaaagacgaagagtgtctatagaaaaccaagcacaccaccagcacagatttctcaacaccaccatctgttagcaatagacaaaactggattgaaccagagaaaaacctaggacgctttctcacgcagacatgtaactgattatgtaagatctctaccacctttgtcttctctctctgaccccaaaactagaggagttcagcagcggggagtgaggatggttgtctcagagtcagatctccttccaacttctctactccaagcagtcagcctcacagtttgtgttgaggggaaagaaaggtaatcatatttatgttagtttcacaatccaagttttaaattggacaaaaataaacttcaaataactgaaactggtagaaagttagaagatttgcactttgggaggccgaggagggctgatcacgaggtcaggagatcaagaccatactggctaacacggtgaaaccccgtctctactaaaaatacaaaaaattagccgggcgtggtggcgggcgcctgtagttccagctactcgggaggctgaggcaggagaatggcgtgaacccaggaggcggagcttgcagtgagcagagatcaagccattgcactccagcctgggcgacagagcgagactccatctcaaaaaaaaaaaaaaggacagttagaagatttgctaggatattcattaaaggacacgagaataagacttgacaatcatgattggaagccttgattagaataaaaaatataactcttttgtatctatgctcttgttgagacacattacatgagtaaccaaacaatgaaacataacactataaaccacagcacatctatggagaaatcaaaatgcactaatcgaaaattataatttcgtgggacattttatttaaatgtaaaatttcatctggcttctcagttttgataaagtagagagtctgtcaattgcttctttcttataataaagtgagtcaatcttccttccatcagcaacatataatacaaattcttcaggcccttgtcaggaatataaactcatactttctcctattccgtttctaaaaaggtcttctaaggaagtaatatttaagaaagttcatctaagaaacattgtaccctttgtctaagtactttgaattctgcctttgaatcaagctagaccactggaagtatatgcacctgaccacaaaaatatatctcctttaaaaatctgtcaccaactttaacttcaaaattttattctcaggcttctttgaattatcataagaaagtttataaaattctcttctatttgttggtaaaaatattgctgatattattcaacgcgttgctcagtgtcatctccatatgagaaatttctccatcaacttagtggcaggaaaaattctctcttgatttgtttctttcttttaaataatgagaattgtgaaactccctaagtttcccttgttattcttgctatcggcaagttcaaagccaaatttgcagctctgtcagagcaagtctcttatacaatatgtacaatgtattccacttcggttttttcttgaatttgaaccttattttatcagtatattttatattttaggggcgttgtctatttgtaaagaaatggagtataggtaaataaatttggttcatgtgctaggaaaagttggttcagatgactgaaagttgatctcctaacatgaaattgattaatctttgaggtgtttttcaaagactacttgcaaaaaaaaagaaaaaaaaaaaagagacttaaaatggcccccaaaatgttatcttcattcattagtttaatatcattaaccaggctaaactgtatattccaataaattgaacaataataggattattttaacattattactgtcagttaattctaaaaaccttatctttggtttttattatatgtaccattatatattgaaaagcttagcagatcctcacatcaatgtccagaaaaattatctccagcattatgaagacacttatatcagttgtagaacatcttatagaagaatagggaagagaggtaatattttgggtaagaatgtagcacaagcaaaaggagagtcagtgacagagtagtgacagcttgtctctaaatgctaattaattatattgatcctctttgttttctcagcttaaacaaaataaagtgcatgggtaccttcaaaacaacacatgatagaagggaatggattcacaaatgacaatagctgtgtttacctggacacctagttaattcactagtttaacaatattggccagtctgtaatgtacatcccaataaactgaccaataaaaggattgccttagcattatggaaatatagctaaagtataagtttaagggcttccataaattaatcagattattattatacataggcatttatgtattatcaggtataaaagacatttgttcaaactaggagatattcaaataatgataaaaatcatctatgactagccacctgggaactatacttttctagtttaaagccataagatgcctcattgctttgacattgctaagtataaaaaggactgtagaataatttgttggtgataaaaatgtctgtggtcacattgctattttacttattatgcaatgtaagatatctactgtggatttctaacagactcaagtccacaaatatatttctcctgactgttcctgacattgcacagaatggcacagggaacacagaccaacacacaaaaagaagagtaactctttgaaaacattttcttcacactgtagtttaggacaaaagtattgcagaataaaatttatggttttagaaaaaacagcaacaaaaatttgaatgaaagacaaacttttgctttttcgaacttttggaagacaaaattatgactctaatgtttcattccttcttctttccttgccattcaaatttctactaaagtgtaagatatatcataaaatttgataatatacactgcaatgcccattgagcagactgaacaaaggccattaatatagcaaggaagacatatttttaatatctttagtctgacattcacttgtcctttatttacatatgcgtaatctcttaattttctacaaattgtagcttatactcacagagttttaaaaaaattcatgatagccctctcattttctgtatctacaattctaggttatatattaccctaagtatacaggtccataggcctatataaagaatttatttgaatttgaaatcttgattttgtgaaagaaacaaatgtcttgagattttgttaaaataagtctggcaagtcttggcccaaagttacactgagagggaatctgttttcctttgaaaacaaaagtattatcaatattttcataaaatgtgagtataaaatagaacatagtattattaaaccatattaacatttcattggcagagatttcactttgttaaaggctgtataagaacagcttaatctcataacccagaagtttttactgttattattgcctctttatttttggctaaagtgtaatttttaaatgagtatacagaaacctaatactatatattgaatgactttaagtaaataaatatccatgctattcatcaggataagtgacctagtgaccagaataaaaaggatatatgttggtagcccctagcacagtatgcctcagcacagaggtttcttgggttactgctagtgaatgattccaattcttggccgtctgatcccacacattacataaattccaactcctgcatctgtttaggtgagctgttggctaaatggatatgtaatgaaattaaacaatatttttaaggtgctttttaggatgggttataccccctctttttctcctcctttccttgcaacctgccctctactcattctttttatgcatatttttgagagcctgaatatgctaggaagagggtttcagtctgttaagaattcacaaccttgtggagttgagatacaattaataaaatttctagtataatgaggtaagtattatgataccatgaaagcacagaggagaaacacctactctgttttgtaaggattagggaaagcaatttagagattatacctaacacaaacacacagatatttgcatagtatgtgagcacacgtttaaaaaaatgtaattttcaccctagaaataagacagtagtgattcagcgtgagttgatatgcctgtctccactataatgaaagaaatataacgtcttaagtatgggttgacatttgcaaactaactgatttttctagaagaatgatgccacataatttaaaaatattaatgcttttctaatctctagtgtattttcaatggctaacatagttaaaaccaaagtgaaatttttattatgtacataatcgaatgcaaattgtgtcaggctagtttaaaaaatatgaatgtcagtcctggcttggcaatttaataactatttggtttttgaccaagtcatttaacttaattaaacctcagtttcttctctgtaaacaagagaaggtcaagcaagatagttttaaaatttctttccaaatttatacgtctgacttttctaaaaaatctggtttacactaatacttaaaagaaattatcttaaaacaataaattataaatttattttttgctcttgctccctgtaaaatttgtccttgtcctgctagtcacatatagtccccactacaccagccaagacttgtcagactggttctgttgagatcatcagtgacttatttcctcacttcaattcagcccacaaagtcattgatagagctggattcacacacttggatgtagacctcgaccttcacaggactcttcattgctggttggcaatgatgtatcggtgagttagttccctttttctttctagaagtcttaaggtaacttttagtttaaaacagtatgagccacaccaaggaatgtgtagatctacagtttattatttttttaaatatagaaacatatttttgagattttacataaaattatgtcaagaaaaagatttctattctttctgtattagtgtttcctgtcctcttttgttgtatcccatgtgtttttctgtttacttttagaaggtttctacacaatgtaaaggtacatggtgtttgacagctgtcttttagttagtttggccatatgtttcaagaaagatataacatatttttagcttgggctttgtttgtcttattgagaaacacttttattttagaaggtgtacatgaaaaaaagtctgaaataatgcagaaaaaaatgtttatttctgtaagtagttaaaaatttaaaaactctagatgttttgaaagaatcagaaacaactgaagaaaataatatgactaaattattatagcctgatttaaaaaataaatccactgatatgcctggccatagtcaacttctccaaagataagtcatgatcattttgaggttttctttcaaagttagaaactaatcagtaacaaggttttggggtactagttttgtctttgaaaataattttatctcctgattaaaatttattttctctgattctcatattggcatatcattttttattagtttttactttgagaacagtttgaaaatgttaaactttgaatgaaatctgtggtcttcatttaacatggaaaaacaggttctgtcatcagttgaaagttctacatacttgttattagaagtttaatactcttctgtacatatccatgaagcaactaaaagctacggatactaaacattttgttgggcttatcaaggctccctgccttttgcaagtatttctttacaaccaatgatggttttgtatcctattctctttttctcattgactttactatagaaaacagtgcttcaagaaagcttccaataaacttaacatactaaatagattacaagccttatctatggtatatgtcagagatttggaatttggttataaatgtgtagaggcggtataatgtgggaatactggagtgaatttttctgagtgtagtctctaatttgaagcaaaagatgtgactatttttaaaaatcctgctgcagaatagatgcaaataatctctcatggaaaaaaccaaaaaccaaaaccaaccatctaacaaacaaaaacgtcttcctgatctgaagattgtatgaaagatgaagcacatctatgtttgagtgggtctagatgagataaaatgttaagagcatgtactagagcaaaaaaggattaagtttattattcacatttgctgtcgtaaatgtgccaacaggagtgttatcgaggaagagggataattgaaatcctaggatataagtagacaatttcttcttaaggtcattggttttaactcagaaagaatacaagaaacaggtggggaattttattaaatagcatgctccttccttttcagtcagatttcggatagccttctccctgactctacctgaataagaatcagttttttttttttttttttagaatttaagggtaggaaaaaatttaaactgggtaagcattattcttcttgtactgccattttctccaaactcttattttggactattctttgagcatgaagagatcaacacatgaattttataaacacacaacagaaagttaaagaaaactctatcaggcataagtttatagagaacagatttgggaagagaagaatgtgtccattaaatatatttattggtcataggggtgtatactaactgtatttatcagcaaccactgagaagaagtgaaaataagcagactgaatttataggcatcgacatccacacatattgagatggctgaaggtgaaatgagtaatattcaaatgacacaaaatggacaactttaatttttacctaatagggtaagcactgtctctaaaagtgtggtccgtagacccctgcattacagtgcttattaaaaataggaatctccagctctcatcccagaaattctaatgaatctctggttgagacatggaaatcatatttaaaacatttacacaatgtaattcttatttaccctaaagtttgacaagcactaatggtgtaaagacatagaaaaagaaaaagaaatgtgtaagcctgaaagaaattaaaccataaatgaaataggccagttgttaaaagtagttctgttttatttaaattggtgtaattacatctgaatgggaggtgctctttcccagtcacctttcccttcaagggagaagagtactcatttatgcaacatggtgatgattaagaaagagaggataatttcagaaaggaggggaaactgaggggggagaacatagacattttttgcttagtttgtgtctgataaggaggatgactttatatggatcataaaaatctatttgtttacaggaaaaaccttggtataaaattaatgtagcagtgttaccctgtgacattagtcagtatggatactgaagagacactccttttaggcttaggcccagagttgctatatggttgtgttataagtatttagcatgtgctcacacttctccttcaactagaatcagccctgatccatataacaacttttagtgagttctcattgcatactaagtcctgtgtggaagaaaactctctgttgagcacctactatatattgtgtattttataaaatgcaatttcattaaattttggtaatgttttgataagtggttattgctttcattccttttaaaagatgaagcacctgtggctcagattgtctaggcggttagtaagtgtcgaatctagaatctaattctgatctttctgattttaaaatatacttttttccctgtaacatattgtctaccatgtgtaggaagctataagtagaatctttgagaagtttacagagaaaatagatggcaacagagaaatagaaaataaacgcacacatatccacacatggagaaaatgttggtgcatagatttaaaaaaccagaagatgtaaagactaatatgaaatcatgcacatttatgctgaggaaagaagtgtggaggtgtaattttactttcatttataagttttaaaaacattttaaaaaatgcattgcctgcccttatacaaccgactttgtatttaaactaaataaacagtgatctatcttttctgcactgtttcaaaggtgatcagagtatagcactttaactacatcatctctgttttctaaaaaggattacatttgctatattgtgaaaatcatgtttatcttagagcaatatttcatggaactaattcactggtctgcagtagctgtctgctaaatgaatctttgttgttctgtcattgttgtctgctttcctccaaaaatatgtcattgcttcaacttaaagagaaaataaatagaaacaatccagagaaacatgaaaaatagcagtgtcgtgtgtttccgtattagcactgagatttataagcatgcctgatggttttagtgcttgtgaaagaggtagattgaacagtcgtgaagcaggtcttctggaagggtaggaggtaaaatgggttctctggcttgttttatggctctatcagggttagagtttagagaaactgcacagagaagttcttcaagtgcgctcctttggatctgctctcattgaagataatagctaagaactgtgaagaatactttcacattttcaggttttaataggtttaaaatgactggactagagagaaggaaggttttaagaggctgagaaagaaaaatgggctgcagaaacactgagtcatgccagaacctgtaagcccaaccttcttctcccatgtacacacatggcctgtgtggtagggcaatttttagaattgcaattctaagatgatagaactaatcttagggggatccaaagtactatacaggcatatttaaattctattttgcaaccttttatctgaaaatgtcagatgatatctctgttttgaaactgcaaaagcagacacagagggatttagcactttgtttaaagttgaactgtgagtcagtgcaggacaaaataataattgctatctttagtttcacatgtactatctgccaactactgtcttaaaacatcatatgcatttaaactttatatcaacctatggttatattatcatactcattttacagatgagaaaaatgaggctcagacaggtaatttttttttgcccaggggtaataataaaaggcagaactgatggttaaccagggtctatctgacttcaaagcctatgctcttaatcacagtgctataccaccctcacaatgtctcctttgtctgcctaagtggttcttttactactttgatttaactgacttactgtcttaaaaggtgaaaaatttacattttcaagaaacattgttatggatgatctttaaagtagacctctaaggccagtggataggaagcattgctgtatgcattctctaaaggaagggaacaaaatgctcaaagatgagataatttgcatgtggccacaggaatgggtgagtcagtcaagacagagatgtagtctgtcctcccacttcacctgtatactgatgtcaatacagtcaaacagaagagttaaattaacaccggtggctacatgacccaagacatattattgttatttttattactattaccatttaagcttgtatgaaaatatgtggcccatttaaaattagttactttacattaaattttgtcaggtcacagttagtaaaatttagagagggtacatatcgtaacaataaaaatattatttgacgtaaatatgctacatatgtaatttcaacatatgttttctcatttggtactttacaacactgagaatcagataattttaatattaccatgactttacagctagggaaaccaaaaattaggaagactgagacttccaaatctctgctaagtgactggtagagctggaatctgagcacacctgttctcacatcagccctgtgctttctagtcctggcttctgccaggtcatgattctgggatcagaagtgcttctttggtgaagcacagataacttaccttggctttcaaaaaattactttatcttagtgtttcaactttcctaattcagaaaataccaaagataataaatgaacactttaaaaatatttcaaaccaatcttttaattatatagtacattcaagtcattattaggcatttggggatacattatttgattcaacaataaagctatatttggccttttaaaaacagggtaatgaattcttgtactaaactgtaggacaactggcagctgcctgactcaaatctctgaattggatgggtccgaagatgaacgctttttaaagttttctttactagttgaatccctttttgcactggaagcttaatgcagacccttgatgtttggagcagaattgctgtgggtggagtgggatagaggctagaagcttcctctaccttcctgtcttttattcccttaggcatacgtgaggcatctgagtggatttttcaacccaccttaaagctaatttttcattatgaaagaggaaataatgacaatggccaacttttgtggtgtatttactgtgtgcctggcatggtgccatctcccttgtgttactttatttaatcttcagaagaatcttctgagttaggtcttatcattatctccatttgtgggtggggaaatgtagatttagagaaggtgagtaactttcctagagccacctaactagtaacaggcagttaggactaatcccaagctgtttgatgcctaagcccaagtctttatccactaaacaagaaaatggaagtcatttgcttaaagtcatagagcttgttacaaagaggctcttgactagaaccttggtcttctgatatattaatattataattattaattgtatctcaaaattatgctgctagagaaaattaagttaaaatagtttaccatctttcacatatacagaatttgcaagagaattagtaaatacacgtcttcatgtcctcttttcccaaagatcattatgtgaaagtggcaatttcccttgattgcaacaatctgttttgcatattataatagtatcggatttagctacgagtgacaggaaacccagagtaacaggggattacataaaatggaattttattccgtttaatgtgaaacaattctggagataggcaggtaagagctaatagggaggttcacaaaataattaggaatctagtctcctactattgtgctgtcctaccagcttgattacgtgtcttccaaatcctggtctactgtggcaatccatgcttcaactagcacatatgtattctaactatgaaatgcacattaggattccagccaacaaaatagagactccattggaaagaaagtattcatatgctgactcttatggacaaggggcactatttgatttttctggtggctgtgtgcctaaccaaagatcaaggtttctgttattagaaaaaaaagaataaatatttgggataggcgtctaggagtttctagtatagctgtattaagtttgaatggtaagaggtatagcccattgtgatgaacataggctggtggatatatagttttgaagtgtaggcaagtgagctgagctgcagttatagatttggtagtcatcagtatatagatatgaattaaacgcatggacattggtaactaaaagtatttgttcttttgggtaaaataatgcatttcttataatttttatggtattaatttgcacagaaatcctactttattctaatatgaacctgagcttatttcactatgttattattaaatgccaatatattagaacgtaattgtcaaggtgagtatataataaaaaatttcataaattttatgtaccatccaaaaattaaaactgaattcttacatatatttcaggtcgataactggggcagaaaattctttaatcaggaaaactcacttttcattttggaagaattatttaaacatcgagagggtctatacatttttcaatttctcctcattgctgaattaattcagatagaattttgttacatgtagaaatttctagactgtctaaagaattcttggtgtatggtttagagtgctttctaaggaaacagcaagccagaggacacaacaaggtgtcagcatgtggcccaactgtcacattcaggcacattttaatcagggtctagagattttaaaaagttggtgtatagtagttatacatattttgggggtatctgtgatattttgatgcttgtatgcaatgtgtaatgatcaaatcaaggtaactgggatgtctatgaccatcttgtgttggaaatattacagttctcttctagctattttgaaatgcaaaacaagatattgttaactaaaatttccctactgtactgaatggtagaacttattccttctatctatacatttgtaccccttaaccaacttctcaatacaagtagtaaagtatgattttcaaagtctggctttctcaggtatggtatttagattgtttcaaataacttgtagtctcttagtttgactgcaaattatttcaaattatctgacattgtagtcaacagaaaaatgaggcatttgaaaaattgcctgaagtctgattgtttaacaaatgctgaattttaattaggatatgtaactttttgtgttatgtgaggcatggaacattagcttggatgaaaattgaagaccatttagatcaatttaaatttccgctgattttttaacatgtgaagaaaaggagagctctcaatatcatacaagttggggctcaggggatgctggaactcgtttgatgtggagtatgctctcagatttctcatctgtttgaactaacactaagacataggttactggttttacagtttagatctacttccattctatcatgcaaactttcttggagtcatctagacaatgtcaagaagaagatttggtaggaagacagctaaaattttaaaaagtttctgaaagtctcaagctatatattagcagccacaagagtgtctctagctcaggtttctcaatcatttttcttctgatacacttgcagtgatatcagcacactgcttgttaattcttatttttcttccacattttgaagtgtgtaaaattccctatgattggctgcaatggcatcgctcgttaactttgctgtgggatattgttgtgtataaagttgctcaggtaatgccagtttattatcttgaactaaaaagagtttgaggaaaagaaagcaaatatattagtagaattcaaacttcagtagcttagtttaagtctataaacccataactaattacttaataatatctttaatttttttgcaacccacctatctgtatgtagttgcaaatttctagagatcaggccaagtgtcaacttaaatatcagtttgtagtcacctgtgctgtaccatatttagttgggaacttaataaaaccttgatgataatcacagtggaggtcagagacattccttactgttgagttgccactaatatttatgtagtacacctatctaacaaagtctattgatatcatatgcaatcttcacaacctccttttaaaggtaagggaaagatactgtcacgtaagttttatggttggctaaacagaaatagttaaactctgggttttgtaacttctctatgagaactagccgtaattattatggtagggaatgcaaacattgtgattcagcccaagcgcctggctgatgctatcagatacttatagatgtgttttatcttccagtggataggacagaaatatgttatttgtaattttatgtggagtaatttgcttgtatttcttctttttttaaaaaaacagcaatgaaaatatataatccatgcacgtatatatgatattctgttttatttctactgtggatatttttatagtcctgttctagaaagtgtgagaaggattaattatgtcaccaatgcttgctggtttgggcttttcacaaagtaaaacacatctcaaatacttttgttgataggataagcaggcacaatcctatgagctaagctacggtcaaatacatatcatatgccaaaacaaatatatagaccaatggaacagaacagaggcctcagaaataatgccacacatctgcaaccatctgatctttgacaaacctgacaaaaacaagcaatgaggaaaggattccctatttaatcaatggtgttgagaaaattggctagtcatatgcagaaaactgaaagtggacctcttccttacaccttaaacaaaaattaactcaagatggattaaacttaaatgtaagacctaaaaccataaaaactctagaagaaaacctaggcaataccattcaggacataggcatgggcaaagacttcatgactaaaacaccaaaagcaatggcaacagaagccaaaattgacaaatgggatctaattaaactaaagagcctctgcacaacaaaagaaactatcatcagagtgaacaggcaacctagagaatgggagaaaatttttgcaatctatttatctgacaaagggctaatatgcagaatctacaaagaacttaaatttacaagaagaaaacaaccccataaaaaagtaggcaaaggatatgaacagacacttctcaaaagaagacatttatgcagccaacaaacatatgaaaaaaagctcatcatcactgttcatcagagaaatgcaaatcaaaaccacaatgagtaccatctcatgccagttagaatggcgatcattaaaaagtcaggaaacaacagatgttggagaggatgtggagaaatagggacatttttacactgttggtgggagtgtaaattagttcaaccattgtggaagacagtgtggtgattcctcaaggatctagaaccagaaatactatttgacccagacatcccattactgggtatataccaaaaggattataaatcatgctactataaagacacatgcacacgtatgtttattgcggcactgttcacaatagcaaagacttggaaccaacccaaatgcccatcaatgatgtctgttatacgtatctcatttcttcttcaatgatagactggataaagaaaacatggcacatatacaccatggaatactatgcagccataaaagaggatgagttcatgttctttgcagggacacggatgaagccggaaaccatcattctcagcaaactaacacaggaacagaaaaccaaatactgcatgttttcactcataagtgggagttaaacaatgagaatacatggacacagggagcagaacatcatacactggggcctatcagtgggtggggggctaggggagggatagtattaggagaaatacctaatgtagatgatgggttgatgggtgcagcaaaccaccatggcacgtgtatacctatgtaacacacctgcacattctgcccatgtaccccaaaacttaaagtataatttttctttttttaaaagaccaactattgattggtggtattgctgtgaagaggcttcttctggtaaatttttctttgaaacactgagccttgacttgtcattttccagtgcttgccattagctttatttgcactagtacattttccccttgtctttttgctgttgctgctgcttttcttttttagcactattctaaaaattacacattaataagcaataataataatgcagcctaagcatattgcttgttttctggcaatttggggctaaaaaaacaaagcatactttaactgttatattcacttgacttgtcactaattatacatgtctccagattgaaaagaaaatcatataaagaaagaaatttgatattactaaagctgttagaattcaatcagtctatctgaaggtgattttacacgaataggtgcacataagttttgatagatgaaaatattgactggacaagtgtttatgtatgttcaggaggaggttaattatacaaacgtctgttgatatgtaaaataaatttattccttcactttactactttctttgagcatacttttttcacatctaatttggaggaattcagtattgaatcacttactgagaaaataaaaaagtaactaagaaataggatcaattatatctcaaaaaagctaaaaaatagggtgaatcagtttgaaaaacaatgctatacagactgggaaaagaacaaataatgtttcaagtgacaaacatcttagtaatgtggtcattaccactattactaataattaaaataatgatgatgataattatcatcctcgttatttgtacaatgatttttccacttgggagctcaaagtaccaaaccgccttctcatttttatctctacctagctcattaggttaggaggggtctggacttattatccttgtttttcatatggagaaattaagacagataattgaatctctgcgtacaagactatataataaatgagttggtggcagggctcagaaatataatctcttaattgtttattcaaagtatttttgactggattctctttttcctttgtcccatattatcccttttgtctacttctagccactcaggagagcatgtcactaaaatagttgtgagtaatgtggaaaggtgggggtcagaagaagaatcacagtggtaccttggacactgcagtgatgtaaattccatgaaaatacatatataatcttccttagtttttttttcatattttaagaatgtcctatgtctctcgctctcttttttttaattcaaacgccataatgttgttcttaaaaaatccaccataaaacaaacaaatccataaattaaaattaaaatttctcacttatttgttattcggcttcttactaataaatattggttgtgtcttctatatattttgttatgcacacacatatatagtttcattatttatgaaaaccgaaacatgaaatgcatattattctataactttttaaaattgaaacttatcattaacctttttaatgttaatacatgaaacctacttcatcaatagaatggctgcattgcttacatttttgtcttgattaaaacttactgtagaacaaatagaacgtgtctaatatttcacaattctatataacaatcatatacttttgataatttcatgttttctacaagcacacattcattttcttcatctgacatgttttgatattagttgagaaacccttctctccctgtattccccccaaagttttgcttacgtgtgttatacccatctcctttcttctgtaacagattaatagcaagcattcagggatgaaggaagaagagtcagttttgggggtttcttaggctcagttgcacataaaacataatctcattgtggagaagactttttatattgcagtaattgacattctaggaacaggtgtttggaattctactcaagggaaaactggagatgggaaaggttgaggagagtaagataaaagcttccctggttacggccccgtggaaaaatcacaggaacaaggcaggagaacaagcagagcccctggagccttccactacatctcagtccctttcccagggacaggattatacagcgatgataacaccattgacttctatgccaatgctctttattttgtgtccagccagagccaggatctaatgatggtgtgacaggggccaacatgataatattatcacttcctgatcctatatcatcaggaaacagagcgttcttgttttctgtaaacaaaaggcatttattgtgaaatgctttgctgtttacacgttcatgatctaattttaggtcccaaagtgctttagacggaatggttatcccgccccttactgatatatggggaaattgagctcagagtttaaatgatttttccgtcgctgatctgttaatgaaagggctgcacttagaattctccttattctgattcaacacccagtactcctccaggagaataccatgttttcctcaagtcctcatgtagcagacagttagcactctagaaaaaagaaaaaagcatagcacacactggcgtaaatacctcaagaaatctaaaataagagtatcatattcaaactccttagtcatctctgacttattatttcacatttctggctttagagtttgcttaccaaatattataacccaatgggacagcaactttaccaatcaaacaaaaatcatgtggatcaatgtttttcagtaacatgtatttttgaaggcagaacaaatagaagttgagggaatctcatgcaaaaagaatttcctgtagctttttttttttttttaagacggagtctcgctctaccgcccaggctggagtgcagtggcccgatcttagctcactccaagctccgcctcccaggttcacgccattctcctgcctcagcctccagagtagctgggactacaggcgcctgccaccatgcccggctaatttttttgtatttttagtagagacggggtttcaccatgttagccaggatggtcttgatctcccgacctcatgatccgcccgcctcggcctcccaaagtgctgggattataggcgtgagccaccgtgcccggccttctgtagcatcattaaagcttaaaggtaaatattagctcaaaacctcaggttctttaggaaggggcctctggttgtttcttctatgtatcctcaaagtttggtttggaaatagatcagaaaattagaagaatagaattagcaactccatgtgaaacctggtatgcttcaagctgtaacacacttcaaaggctatttaagattctagagtgctagagaaaaggcttaaaatatttttgtagcccctgcagtgtctaactctatatcaagtacatggctggctcaacaagtgatagctaacatttaatattgcacttttctacatgtcaggcattgttacaggcactttatatgtagtacttcatttaatcctcacaataatcatatgaaataggtactatcattatcatcttccttttatggatgaggaaacccaagcacaaaagtcaaactacttgcctagcaacaggagtcagagtcaggactggcctcagcagcctggaaccagggtgtgctctaaacccagacagtacacgaccctccaactgaatgtcctttattcccccaaaatatctgttttgtctaatgagtggatgtgttgcatgctctgaaataatctatctatttattttcttccttaggccagatgtggtgagggctaggaaaagagtttgttgggaaccctgggttatcggcctcgtcatcttcatatccctgattgtcctggcagtgtgcattggactcactgttcattatgtgagatatagtaagtataagctgccttggcatcatgtgatttaccccaaatatttcctcataccttgctgttttgatttgcctcaggcttattcatttatcactacgattcatttgcatagcctgtacaaagggatctttacctgctttctctcttatttagtcctcataagtcaaggaggattcttttttctatctttgatgtagtgatgctttctgctgggaacagcatgcttatttgcatcttccttaataagcaataagtgagtattaatcaaaggaaaactacaggatagctagaaccaatgtcttgagttgtttgaggtcacagggcaagcatcttgatttaaaataattctgaccgggtgcagtggctcacgcctgtaatctcagcactttgggaggctgaggcgggtggatcacttgaggtcaggagtttgagaccaggctggccaacatggtgaaaccccgtgtctactaaaaaaaaaaaaaaaaaaaatagccaggtgtgatggtgtacacctgtagtcccagttcctggggaggctgaggcaggagaatcacttgaacccaggaggcggaggtttcagtgagccgagatcacaccgctgcactccagtctgggcaagagagagagactcggtctcaaaaagaaaaaaaaaaatccaactcgttgaagtcctgacatcccaataaatcaatgacacaatctggagtcataaagaagtaggctctattctgtaccagtaagttacaaaaatagtcatagtgatgtattgttgagtaagtgcctatttctgttattaaaatctcatcttaggatatattgtaggtgattaaagaggatagggtatgccaagaaagctaattataaagatgttcaccctgcggttatcaggtacctcattgctagatgaactgttagttgctatgttattagaaaggtctccagggtacttcagaactgttattctgggatgtaacagcccttctgaagtttcctcctactctgcctagggttttaattacttgactcaaccatgacctgttagtttaatatcttcctctgttactagattatacttggatgttcaaggcaccgtaaccatagaagctaataacttgattctaatttaattgggaccttgttgaagtttctttccagtaacgagaaagagtactctgtaacctggttatcttcctctactatccacgcaagtataatctcaatttacaaagcaaggtggatcatttctggatagtttaaaaaaatatttaaaacaaagatttttttggtagaatttgcatacaggcaagtctttaaatttggagtatctgcatattaataacagatttttctgtagcacactttttttttgctttttgagacggagtcttggtctgttcccaggctggagtgcagtggctcgatctcggctcactgcaacccctgcctcctgggttcaagtgatttttgtgcctcagcctcctgagtagctgagattacaggcatgcgccaccacacccggctaattttttctatttttagcagagacagggtttcaccatgttcgtcaggctggtctcgaacttctgacctcaaaagatctgccttccttggcctcccaaagtgttgggattacaggcataagccactgtgctgggactgaagcatactttaaataaaaatgaattgctggaataactttatagttctacagttctgctgagaatattgagtcctactttgttgtaagcatcattatttgtccccatggatgtctaggactgttttacacacttttgtgtgtctagaatttatcagaatcttggcacatgttatgtgctttataaatatttattaaatactgaatgataatatcaaatgaatcatgcctacaatattttcttgggccatacttcggcttgtctgacttcacaaggaattcctagtaacactaggggctaatcacctcagtgagagaaaatgtccctttctacttctcatttgcctcttcccaagccaagttttataagattcataaatcttactcatatgtatacagtgaaaacttggcaagaattttttcagtaacctgttcctgaatcctgttgtttggatgatcaactgagtaatactgaacacacagcttctactgcccacacagtacacctgaataaacagtgattgttgtgatgtgtgttactgccttctatttgtgacctgctttctgttttgggatgtaaactaaccgagtggctttggcagacaaatatttagaagctgacatgccaaaataaccaaatcaaaccaaaccaaaaaaatctgtcacagaaatagacagatacagacaaaggtaatcagatttggaaaaatatcattttggttctcatttcataaagcccaggacaatgtagaattctgtgtatggttcgtgtctggggcctttgggggtgcatttctgcccctgtgtaatttggatgtcagaagatgaatctgttataagcaacatcactgcagattatagaatcacaaaactgctagaaatttaccaacaaactcatgtttatccttatttttaacttttctgttaatattcccaacatattttagtaactactcataccatatatttatggcagctggtaatatgttttaacagtggcatgcttaagtctacagggtaaagtaaaatactgagcacagataataaattgttaacttggttaaaccatatgaaattgccaatatttgactatttttgacctgtactaatggtgattttaaatcattcaatctaataagccaaaaaactacatttaagggtgtagaagggtctgttagcattctgtctagaatcttgctatttaatatgtgattagctaccagaagcatcaacatcacttgctagcttgttagaaatgcaaaatcttgagtctaactttagacctcatgtaccagaatgtgcattttaacaggctccctaggcagttcactttcacattaaaatttgaagcagaattctagaagaatggatacaactccacagagagttatagttaactatgaggcagatgttaaaaaatacaaatgtagtagaacagtagtttacagagatagttatgagttatttcccagtatttcaataaatttaaaatcttacttgaagttatgtatatttccaggtacctgcctgaatttcatgtcaccctggccattcagagaaagggaggtgaggaaggatggaggaagagtaaaacctcccaagtccttcacttaggtctcttgtactctggtgactcaactttcagtgtctcctgcctgccattcatctcttttattcatcaccaaccgcacccaagcccttgtcagagtctgatggctgcttccctctctgtcccatcaaatcctctggatggccagggtgttttatttgaaatacaccagtagttttttgcataacttttatacaacaaaagatttgtcctctagctttaataagtggctttttttcctactctaagaagcagcatgtgaagtaagtgggtactttgggagttagtcttggctatgtcctgctggacttgggcaagttatttacatttccaagactgtaatctattaaatgtggataacattgccttttcatggagttattgtaaattaaatgagatatgtgaatgtactagggacactggtgtccagtgttagtttccttttcttctgtggtttaagtgaagagggaaagaatagggaggaagagaaaggaggagagagactgtgactggatgagccacagtctgctttcctatagtaactatatacaactgtcttgatcaccagtgtatttctaatggttgacacagtgtctcttcctgaaaagtggttggcattaatatttgttgaatgaatacattaattttctgagggctgtctgcttgctttatgcactggagggtagaggaaaagttatatcacattaacttttcagcaggtcaaaaatgtgggttgcttaaattgaatgcagaatgtagagacagtggctaaggagcagacaagccaacccctgtggttggtgggaaaaacatacatgcagtgacaagggacccaggtgaaactaaatagtgtccctggaaggttatgccaggtggcaactttagctccctaaacttccatttactgaatcccttgcattttaattcctaacctcatcttccttttcagccaaaataaattttctcaaactagagttcttgcggccagaattgatgtatagttgatggaagggaaaagaaaatctatgtttggaatataaaaatgcagtgacccttgggaggcttctgaatccatccctgtttgtatgctcagatggcatgacttgctgtctcttgtggcttacttaggaatgagtaacacatgaataatcagcccactgttccaatgagctacttgtacagtactccaggaacaccaggcatttcttacagcttttattctctaaatcacatgatgataaatgttgttgttttttatcctgagataactatgaggcctggggcaggatgatgatgatgacctgtgctaagagcattccttcctgtttcagtcttccagcaaccaccaagcggggatataatgatgctttacacacatctgataaaaattatgatagtgttttgcttctttccttgtagatcaaaagaagacctacaattactatagcacattgtcatttacaactgacaaactatatgctgagtttggcagagaggcttctaacaattttacagaaatgagccagagacttgaatcaatggtaagcaacttgtcatctacttctagtgcatttgctttcactttttaccatatttttagcatcctagcttctaaaagatccattcaactaacggatccctgtgtatttgcaaaatgaaaagaggccctaacccaaggaatataaaacaaaatggacaatacatcacttagcacaatatgactcacagggttgaaccaaagaaactttagccattcggtcaggtccttcttactcacctttccttagctagtgatatactcttgatcagtagagtccagagattctggaaatgtgagtgtggcttaaaatatatttgttgtatcctagacttcctaaaaaagagaccccgagcagaagattgccaagattgaaactatttaggcacatacctaaatagtctgttaggttttaaaaatatctaaccttcaaccagcttttggtatataaatctgtagtaaatccacagatatgcaactctacccagtttttaaaaatatttaaccttcaactagcttttggtatgtaaatccacagataagcaactctacccttaacgcatcaacattcatcttgagggatcaattaaatacttaagaaactggaaaaattagcagcatgggccaaaagaacaagggcctaagtggtaacttcttgtcattatcagattaattaaagaataatttaacttttcctggaaacctgtgaggtaattcatgatataatgtgatggaaagaacactgaactgggagctgggaggcacatgtatctccaatggtatctactaggtaatgatacatcacttggaatattagtttatcattctgcacaaagttctgtaaattgaaaattaaggtattaggttagataatttccaaattgtcttccagttccaataacctgaataagaatggaagtgagaccctggaaaccgcccagtagacagaagcctggggatttggccaccttgctgagacagtggttgaatcctggttacatttgcacttgcaaacaccaaatcagggaaatatttgaccaggctcttctctaaggctaaatacatatgcaaaatgaaggaaatgaaattgaattaaaaaggtcaagaagagatgccactatttcccttgttctttgtgccattcattcaaataaattttatttaagtaaataaaatccagacagatttaaatctaaaggaatatacataaggctctttaatgccttcaaaattaataatagttttgaagttacttgacaaaaattaacccttaaataaaaattttcttgtgaatactgccatcctattcagaggacttctgctattcagctttgtctcataattgcaagaagtgtccttagtaaaaaaattcggaattaataaaatgtaagaaagaattaaaaggctcattgcttctgttaatcaccagcatgtagtaagtgtttactaaatatccacatactggaaacaagacacctttgagtgtttccttacataaactcctaattaaaaaattaagttgcctagaattcttatttagaataataactaacgtctctacaaaaatagactctttcactttagtagagtaaaactcataggtgtgttaggctaagtatcccagttcacctgggcctttttaagagcacttggagtgctgaacttcgtgtacattatgccaggaaaactgacaactttgtcactaggtttgggaagcatttgacatggtcatgcactcatttctataatccaagtattatgtggcagaattatttcatttcctttgtctatgggcagtaaaagtccttacttcagagtaaaatttctcactcttaattttgaagaaacagcatgttcattttctttggtctctttctgagcattagtacagcagatatcacttctggccccactgcggttccctactcctatcattcctaagacagcgttcagttgaaatcactgagaaaaccacaatagattcctcaagcttcctcagttccactcactgtgaaatgtcaatgttttttgctctgttttgttttttaattttctaaaaagctttgaattaatttgtggaatttcagaaagttgttcttgctgatatattttgaatatttttacaaacaggtgaaaaatgcattttataaatctccattaagggaagaatttgtcaagtctcaggttatcaagttcaggtatgtaaatctgaattgctgacttctgaatttaaagttgaagctgttaatctgctcagcaataaatatgttttcaagtgttaaagatataattcaatccaacaaacatttgacacttgtcctgtgtaagtcatgggttacaaagtcccttattcattccttaaatcccaaagtaagcatttgcaagatggttgctggggacagaggtataattggtgcctatgttataaaattgttttctgggaaacttaccaagtacagatagtactaaatacagatagacctaacacacatccttggtttaatggcaagtagtgccccatgtaagacaatatagtagatcaggtttgtctttagctcttcttcctcctattaatcaatcttctttatcttcttctattccatccctccattctcaaaatatgtagctgagaaaatctcatctgtcaactaaccattgataaatgggtttagtacataatgttaaggaaaatattataagaattttcaataagatattgacataatacaaattatttgtattaaaaaacagaataagaattatttccaatattattccaatgacaaaactttaaaagtttcctgccattctattacttagctgatatctctaaggcattactttgatcactgtcttctaaaaattctgtactctctggtgtttgagatactgccctttcttggatctgcaactacttctcttatctttaagtttcactttctcaaagggacctcattcacccacatggtctcatatgctattgaaatacaagtttctatctctagtctgaactatttttctgatttctataactatatacacatccccatgtggaagttccacagaaaattccctaactcaggaagaatccaatcacataaatgagaaacctggaagtcatcaaacactccttcctttcctggtcccctcatactttatgaataactaagttccactaattctattttcccaataactttccaatttgctcacctctttattccagtaatcttgctactgctactcattattctgtcttctgttactgcaatagtgagaagagcaagtttattggaaagatgaagtcaattttggagatgttgaatttacattctaagggaccatatgaacctgaaaaatgagggtgactcagtagagggaaatggaactgagcagaagatagaaatttgctcatgatcaactcaaaaatttggaagcatgggtgtaaatttctcagaaaaagaataataaaagggaatgaaaaggatgacaaagaaagcttgaagaccaatatttaaggtgatggaaggaatataggaaacttagatatagggaaagagcaggaaaatagaaaaatcatgacaaaatcaccactgatgcaaaagataagaagtttcaaagagagtgtggtcggcattgacaaatattcctgactgagtaatataaatattgaaaagaatccactggctttgtcaactaggatacttgggttgttacttattttcgtgtcctgaaaatagtgttacaattaacatgtttataggtatgtccttgcacaaatgtatgagtgcatttgaatgtttaatttctagaagtggaaatgctgtgccagagaagacagatattcaaacttataatagataacactgccatccaaaaataagactctaatttgtattcccacttccagtttatgagagtagtggttgatgcaatatatagtgaagagttagattcagaagtgactatgaaaaggagtgggtaaagtagctggcaggatgattccaaggtagtaattcatacaaatagtattaagactaattaatgctctgtgttgaaaatacagtcacatgaagtcagtacaatttggtaaagcggtcttatatctttaggattaggagttgtttaggatagcctgaagattgtttaggggaggtaagtagacttgagtcacaagaataaaacctgaaattcaaaaccacagttgatttcatatttaagacacactgtatttgataattttgaatggtttttgacaaggtgtctttttatattaatagccatatacttaactagaccttttgatggtaagggagaccatgaacagactaactcactatatgagaggctgaatttgtggttcttcacatagtaaacagtagcaatatagaaggaaacatttatggatgtattttatgtgtgcatttcatgtaagtgataaagaaaaaagcagattgtgatattacccttctttcttttcttttctcttttcttttctttctctctctctccctctctctccttcctcccctccattcccttctcttcacttcctttttcctttcccttctccttccttccttttctcttttctttctttcctccctccctcctttcttcacttcctccttccctccctccctccctcccttcctgcctttctttcttcttttcttttctttctttcattttcttcttttttggcccacagtcaacagaagcatggagtgttggctcatatgctgttgatttgtagatttcactctactgaggatcctgaaactgtagataaaattgttcaacttgttttacatgaaaagctgcaagatgctgtaggaccccctaaagtagatcctcactcagttaaaattaaaagtaagttaatttctcttatttttctttcatagaacagcttcatgttaggtttgatcttggcacttattaaaaaattttttttgatgtcctttaattctggggtcttgccaccaacagtatatttctttggaactaaatttgtcctaatgaagtattttaatttttaagactaccctaaacttaggcctcccatgcaagctttttattaactccttagcagttttctttatattacactttatagtttggctatagaatccaattataagtgaagaaaatggctttgtattttcttctttttcttgttgctttcattgtgtgttctgagggtgtggtatatggaaaggttcatgccatttacacatttgttttcaaatgtcattaatataccttgctatactttcttcccttaaacttttcaccagtgaaacatttataataaacttatttttggtatatttacaactataaatgaaaaatttaggtagatttttgttgttcttgttgttattgtttgtagggccacatgggacaaaacaagtgatgataggtcctcacatttagaaaataagaaatatgagatcctcagtggaaattaagatctggctaagggctggttcatatgttacagaacaatgaaggtctatagaaatactatctgggcacaagtataatgttacattttctagaagttacattaaaaataaaaataaacatgtaaaattaattttcaataatttgtatattcaacccaatatgtccaaagtattatcatttaaacaaatagtcaatgtaaaaattaattattcatcaaatatttcacttttttttgtagtaaggctctggaatctagcgtacattttatactgatagtacatttcaatttagactagccacactgcaaaagctcattggccacaggtggctagtggatacagtagtggatatggcagcactggaaactacagaataggggacaagtagagagaatgaatacaaactgctaatataatatctgatagatctaagtagatgcctaaattgatggccagccaacccacttgcttaggaaggaggcttcagtagtcagggacagatacataatttatgcgccttagcacaaaatgaaaatgctagacctgttttcaaaaagcaagaaaaaagtgctgttaaaagtacaaagatataacacttttctttcttccctggtctcgctctcgactttccatggtgttttcatttgctgattattgtcattctaagagaaaaaaattaaatttgtagattactaatatgagtttaattgtttatatcatgcaatgtcgatataaatgcatatataagtacatttaacttgtatttcaaatcatggaaattatgcaactatatttcgtagcttatacatacatgtttttcatttttgcctcaatggaaatagtacaaaaggctaatgactctttttattttcctggttaatatgagaaaattctaccaacactctctaccttcagcttattgaggggtgaggaaggactagaaggaaaaggagatctggatttccctatctttctctttctacattgtagttttcagcaaaagttgttggctaatacacagaagtaacagaagcaagaaaggatatggcaggatctgttgttcatttgtgtttattagaatgctattgtcttttctatgggttctaagcaagttttggttcaaacagaaaacatggcctccaaggcatgtcagtccacctctgcttacttaatggaagggatagcacacttaccttgtacttgctttgagtcttgctgaacccctgtggattgtgggtccactagaattctgatttcatagggaattgtgaatgatatatgcaaatggagtggaaagaaactatggacacacttattgcacatatcttgtctgccaacactataatccattatcctattgaacttcattttcaaaacacaagttacaagataaaattattaagaatgtcaagtgagcaatagcagagcattgtaccaagcacaaggccattgtgagtgtgagacccagtgcagatgtataagtcacacatgaagccagccttgtcagtgctatcaatactcagagcttgacattttcctaggaagagcttgagatagagaacaggttatttgaaacaaagagatcagaggtggtccttttaatattaactgagactaaattgtaaattcttccttatttttgccattttccccacaagtagccagaataaataaagtcagaaagaaggccttctagaatatagatttccacttcattcatactattaaatactaaagaaaaaaattaacactaataatatttttgcatttagagcatccatccttccatgtacaaagaatagttttggtcattagaactctgctgagtcagaaagtttgagcttagagttttatgtatctattagctgggttagtgtttgcatagggtttgagactgactagtgagaagtcagcaagctaagaagtcattggctggagctaaatgacaatttgagggcagactgtcttttgaaatttgacttcaaaaagggtaacattgtttttaactgtgagtgagtacaaatttatggagatgctactcaggtgtgttatacaaatgggactaggcttatgagctcaatgatacaatctgaaataatggttaataaaggtattgttacatttggggaattaatactatggtttagagtagtatttcccatggaggggctgtggactctctgcatcttatttactggtataaaatccaaattcttgggcgtcattacaagctactgaattagagttactgggaaggtgaacaggagtttcattataaatatgcttcctatgtgactcttacccacattaaagtttaacacaccgttcacattctctgcaatgtgatgatcatcctatgtctatgacaagctatgttgccttctttataatctagagatactgttttataataaaattaagcagccttttagtatttgaaatactcggaggcatagtgtaactctgatgtgctgaccctatttgccatttctgtgtgtttcagaaatcaacaagacagaaacagacagctatctaaaccattgtaagtttaatatatttattaaaatagcattacctgaaggtaaaaagctaacactataggtcatttaggtttactttgtgttgatatcatagggacagaacacataaagtttgattaatttgtgtacagttcatggtactttatcatatcttggagatacattttattagtaaaggatagcaaaattgagataactttggagtggatgtatgggtgcctgtggcagatgtgtagtggaattgagttgtacagctgttaaagaagaggcaagaaatgtttacttatcaatgttctgtttgtagatatctataagataaaacaaatctatacattgtgtttttcagctagaggcagaaactcattgtcactatatcctagataaaatcttcttgatgttattaatcctacggattaatacgaaagtgcaggaaattatcgggtcatggaagagtcacagaaagtgcaggaaattatggggtatattttaataaaattactgaagacacatagataatatcttcacctatattataaaagtgctgagtctaggcctagcatttttcttcgcctatagccaagtatgccaccatgatttacagtatacattcaatagttatggggttgttgcacattacatttctcttaaaaggtggaaaaatatgtgctactcaccagctcatatagttggttaatttctaaaatcaactaaacacaaaaccaaaagataatctcattacctaaatagcatatattctcaccaccaatatttattgggaacctaccatgtgctagcactgtgttagacaacaggcattccaaatggataagatataatatctctacctgaagcaccttatactttaatgggactaggtgcatgagactaattcatgaacacatcattcttaaacaacacttctcaaccaagggaaatattgttggccaagctatcatgccccactgtggcatttttgtcatgaatatagggggagggctactggcatctatagtggatctacagtatataggccaagatcttatgatgcacagggcagccccctacaacaaagaattaaatggttcaatatgttagtggtgccaaggttgaggaaccctgtcataaacaatgtcagtatgtatacatacacataagcacacatacagagtgtgtttgttatacacataagcacacacacagagtgtatttgttactattattattttggaagcaccaagaaagtaataactaatccagattggagacaggggagttagagaaagcatcctagagaggtaacaactgatttagattttacaaaatgaacaggagttagctaaataaaacactacagtttacagaaaggtaagagcatgagaaaacatttgatacttttggagcacaaagtagaagaaatatgggacatagtaacacaatttgatgtgcaaaacaactgctaattaatgcacccaccaatgcaccccccctctctcttttgcaggctgcggaacacgaagaagtaaaactctaggtcagagtctcaggatcgttggtgggacagaagtagaagagggtgaatggccctggcaggctagcctgcagtgggatgggagtcatcgctgtggagcaaccttaattaatgccacatggcttgtgagtgctgctcactgttttacaacgtaagtcttgaagcttgagaatgattgggagtgaacaaagtgcactgggttttggcaagaaaatacctcatgaattttgggagatatgagtttagcataaattaaaaatagtgtgtatatcacaaaagactggatcatttgtaaacattagtaagaggttttaaagtctggaaatggaaatggagtcaaagtatatgtaaataaataatcttttgataaacacacaatagtttctcaaagaaagcaggaattttaaagtcatttttggatttgaatttgctgtcaaacaggagtgctctatctctgctgagtaccttaatcagagatggagtctggataggttgtaggtttgatcctaagggggaaatttcacatggtaagaaaaagaattaaatacgaagaattatgtaatgaagatatgaagaatttggaagtagcaagttgtataaatgaatagattgactaattatattgcaagaaatggaggacccttcaatctattgtcaaaatgtctatagtatataaaataataatactttgttaaattattgtgtggactttttggttttcagagaaatgtgtatatttctgggtggggtacatgagacacatagaatatattaatttctcttattctgtacagggtactttccataggtcccttggagtcattaatatacagaaaaatcaaaaagccttagcatttggagtggatgacttggcatatggagtggcatgtatattataggaaatggtggctttttcacctggtcagaaccctgagccttattatcaaattggaaagagttctatacatcaaaactataaaaagaaaaaaaaatctacacctgtagactaaattatttaatataaattattcgactggtagcatggtaaaaagaaatttattcttcatttttttctccccagatataagaaccctgccagatggactgcttcctttggagtaacaataaaaccttcgaaaatgaaacggggtctccggagaataattgtccatgaaaaatacaaacacccatcacatgactatgatatttctcttgcagagctttctagccctgttccctacacaaatgcagtacatagagtttgtctccctgatgcatcctatgagtttcaaccaggtgatgtgatgtttgtgacaggatttggagcactgaaaaatgatggtgagcatcggaagaggaactcaagtaaaagttaaattggtattttatggcatttaagcaatgaaatgccattatgccaaaatatgttagttgtgtggtcatatgacctggaccaagtcaggccctaaaagtgaagtaaataacttggaaggcacaaaaattccttcctgcctaagttaatatcgagtaaattgctcctactatatactacagtcatagtactgctaagatgtctgaaaaagcaaatatgtctcctagccatgaactttctttagagaattaaccagtttagagattagcaatcaataatatacccaattctgaagattggagaatcataaagccaccattctcccctactgaaatttccttgtaatcttaacaatggagtggacattatttagataacttgtggttctttcctaggcacccaactttttgctcaaagtagttaggaacaaattatcttcccaaatattattgttctaaacatatgtagtctaagattctgtatcactatcttttttttttttttttgagacagagtctccttgttgagacagagtctccaggcagaagtgcaatggtgcgatcttggctcactgcaacctctgcctcacaggttcaagcgattctcctgcctcagcctccccagtgattgggactacaggtgcccgcctaatttttccatttttagtagagacagggtttcaccatgttggccaggctggtctcaaactcttgacctcaggtgatctgccctcctcggcctccgaaagtgctgggattacaggtgtaagccaccgcacccggtatcccccgctttttttttttttttttttttaagatggggcttctttctgtcccccaggctggagttcagtggcccgatcttggctcactgcaacctctgcctcccgggttcaagagatttacctgcatcagcctcctgaatagctgggattacaggtgcatgccaccacccccggctaatttttgtatttttagtagagacaggatttcaccatgttggccaagctggtcttgaactcctggcttcaagcgatcctccaatctcggcctctcaaagtgctgggattactggcgttagtcaccgtgcctggcctgtatcaccatcttattcctaatcatgaaacattttcttcaagtttataaaatatatgtatgtctacaaatacaaagacttttttttcttttaggttacagtcaaaatcatcttcgacaagcacaggtgactctcatagacgctacaacttgcaatgaacctcaagcttacaatgacgccataactcctagaatgttatgtgctggctccttagaaggaaaaacagatgcatgccaggtaaacagttttgcccattagtaggttgtgtaattttttgtttacttttctttgaaataattatatatctacaggaagttgcaaagatagtacagaggagtcacaacatctcacccagttttctccaatgattacatctcacataactatagttcaatataagatctgggaaactgacagtcgtacaaagtatgtgtctaattctatggcattttgtcacatctgtagatttgtgtaaccaccactacagttaagatgaagaactattctatcaccacaaagacctacctttttccctcctcctactatccctaacatctggcaatcactaatttattctccatctctataatttttcaattttcagaatgttatataaatagagtaacagtagctttttaaacagaatttaattttggatcatctattggtatttttggctttttgttgtagaaaaattttagtggttcctttaagttatatatatgtgtatataaatatatatttatttatatatacatacataacatcactgtctatgtgtattgaaattttactagttttggtggagtatagaataaaaaacttacttccccttaaatccctttgcttttccctctttaatattaaacattaacaaatataaacattaaatattaataaatataaatattaaatatttgctttatattttgagaaccacagaagacaatgttttgcttcaactgtcaaatgtaatttagaaaacataagaggaaaaggaaagactatttacctatggatttcttctttcctctttcctgattccttttttaaaaacagtcatttctgttttaggaacttcttttagccactcttttagtataggtatgctggtgaaaaattctcttagattttctttgtctctaacagtctttatttcttcttcattactggagcataatttagcactgacagttcttttctttcagcatttaaatcattgcctctgtgatttctgcaaggaatttgctgctattagaattatttttttccaatagatgaggtgtcatttcttgctgtgttcaagagtttgtctttagttttcagaagtttgattatgtatcttggcatggatttctttgggcttatcctgtttgaggtttgctcagctttttgaatatgtagatttatatcctttgtcaagtttgagaaatttttggtcattatttcttaaaatactctttcagtcccaccttctttcttctttccttctggaactctaaccacagcaatgtttactcttttattatagtcccagagtttcctaagcttttgtttattttttttgcactctagtttctctctgtttttgagattgggtaatttcaatgtatcttcaagtttactgattctttgctctgtcttctctattcttatgttaagcccgtccagtgagttttgaattttgcttatcatattttttagttccagggtttttctttgtttcttctttttatatttactatttctttgttgacacttcctatttcttttcctttgttttaaacatgatggtaattgctcattgagatgtatttatgatggctgctttaaaatctttgtcaaataatttcaacatttgtgttatctcagtgttggtatctgttgattgccttttctcattcaagtaaaaacttttatatttcattgtatgatgactgatattcagatatatgctgagcatctaattattatttattctgttttgttgttgttgttatatcatgcttttaaatttatattattttatttaattaattactttgcttcttccaacttttattttaggttcagaggttacatctgcaggattgttacatgggtaaattgtgtgttgctggggtttggtgtacaaattatttcatcatgcaggtagtaagcataataaccaataggtagtttttggttctcatcctcctcccaccctcaaccctcaagtaagccccagtatgtattgttcctctctttgtgtccatatgtactcaatgtttagcttccacttataagtgagaacatgaggtatttggttttctgttcctgcattcatttgcttagtataatggcctgtggctgcatccatattgctgcaaaaaccatggtttcattttgctttctggctccatagcattccatggggtatatttaccacattttctgtatccagtccactgttgatggacattttaggttgattccatgactattgtgacaattgctgccatgaacatatgcatacatgtgtctttatggcagaacaatttgtattcctttgtgtataatatacccagtaatgggattgctgggtcaaattgtagttctgtcttaatttctttgagaaatctccaagctgcttcccacagtggctgacctaatttacattcccacgagcagtgtataagcattcccttttctccacaacctcaacaacatctgttgtttttttgactttttagtaatagccattctgactggtttgagatggtatcttattatggtttttaatttcccatttccctgattagtgatgttgagcatttgtccatatgtttgttggctgcttgtgtgtcttcatttgagaagtgtctgttcctgtctgtattaggctgttcttacactgctataaaaaaatacctgggtcgggaatggtggctcatgcaggtaatctcagcactttgggaggccaagggaggtggatcactagagctcagaagttcaagaccagcttgggcaacatggggaaatcctgtctctgctagaaatacaaacattagccaatgtggtggtgtgtgcctgtagtcccagctacttggaaattatgaggcaggaggattgtttgaacccaagaggtcgaggctgcactgcacccactgcactccagcttgggtgacagagcaaaaccctgtctccaaaaacaaacaaacaaactaacaaaaccaagtaaacaaaaagccaatattaggtaatgtataaagagaaaaggtttaattggcttatgattctgcaggctttatgggcagcatggtgctggcatctgctcggtttctagggaggaagcttacaatcatggcagaaggtgaagtgtgaaatgggagggagcaggtacatcacatggtgaaagcaggagcaagagggatagaggtgccatacacttttaaacaatccgatctcacaagagctcactcactattgcaaagataactccaagccgtgagtgattggctcccatgacctgaacacctcccaccaggtcctaccttcagcattgggggtgacaaagcaacatgagatttgggcagggataaatatccaaattatatcattctgctcctggcctctcccaaatctcatgtcttctcacattgcaaaatataattatgccttcctaacagtccccaaaagtcttaactcattccgactttaactcaaaaattcaaagttggccagatgcagtggctcacacctataatcccagcattttggaaggccaaggtgggtggatttcttgagcccaggagtttgagaccagcctgggtaatgtggcaaaactgcatctccacaaaaaaaaaaaaaaaaaaaaaaaaaaaaaaaattagctgggctttgtggcatatgcctatagttccagctgtttgggaggctgaggtgggaagattgattgatcgtgggaggtttaggctgcattgagctgtgatcgcaccactgcagtccagcttgggtgacacagaaagacttcatcttggggaaaaaaaaaaagtctgaagtccaaagtctcatctgagataaagcaattcccttccacctcatcaatctggatttcactgtcgatgtaactatcagcattttggtcacaaccatttaaccagtttctaagaaatttcagacttgatcatatctgtcttctgagccttcaaaattcttccattctttacctgttacccagttgccaagtcgctttcacattttccaatatctttatagcaatgccacactcatagttaccaattttctgtgttaggctgttcttgcattgctattaagaaatatctgaggctgggtaatttattagaaaagatgtttaattggctcatggcttttcagactttatagtaagcctgatgctggcattaacttagctcctagggaggcatcaggaagcttataatcatggtgggaggtgaaaggggagcaggaacatcatgtggtgaaagcaggagcgagagagagagagagtgggaggaggtgccacacacttttaaacaaccagatatcgtgacagttcacttgctatcgcaaagacagcactatgctgtcagggatccgttacccaaacaactcccaccagcctcacttccagcaatggagattaaacttcaacatgagatttgagaggggacaaatattcaaactgtatctatgttttttttccccattttaaaagggagttgtttgttttttgcttgttgatttgtttaagatttcttaaagattctggatattagacctttgtcagatgcatagtttgcaaatattttttcctattctgtaggtcgtctgtttactctgttaatagtttattttcctgtgcagaagctctttagtttaattagatcccagttgtcaatttttgttttagttgcaattgcttttagggtctttgttataaaagctttgctaaggctgatgtccagaatggtagttcctaggttttcttctagagtttttatagttttaggttttacacttaagtatttcaaccatctcaagttgatttttgtatatggtgaaagaaaggggttcagttttaattttttgcatatggctagccagttatacccagcaccatttattgagtagggagtcctttccccatttcttgttatggtcagctttgtcaaagatgagatggttgtagacatgcagctttacttctggcttctctatttggttccattgatctatgtgtctactttttttgtactagcaccatgatcttctggttactatagctttgtggtatagtttgaagtctggtagtgtgatgccaccagctttgtttttttgtttaggattgctttggctattaaggctcttttttggttccatataaatattacaacagtttttactaattctgtgaaaaatgacattggtagttttataggaataacatttaatctgtaaatttctttgagcagtatggccattttaacaatactgattctttctattcatgaacacaaactgttttaccatttgtttgtgtcaactatggtttctttcttttttttcttgagacaaggtcttaccctgttgaccaggctggagtgcagtgccacaactatagttcactgcagccttgaactcctgggctcaagcgatcctcccacttcagtctcctgagtagcggggactataggcattcaccaccacacatggctaattttttagatttttggtagagatggagtcttgccatgttgctcatgctggtcttgaactcctgagctcaagcaatcctcctgcctctgcctcctaaagtgctgggattacgggcatcagccactgtacctggccttcaactatgatttctttcagcagtgtttttaattctcattgtagaggtccttcaccttcctagttagccatatgtctatgtattttattcttcttgtggcaattgtgaatgagattgcactcttgatttggctctcggctaagatgttaatgttgtatagaagtgctcctcattttagtacattgattttgtattcagaaactttactgaagttgtttatcagttctaggagcctttgggcagagactgtggagttttctgggtgtagaatcatatcatttgtgaagagagatagtttgacttcctctcttctatttggatgccttttatgtctttctcttgcctaattgctttggtcaaaacttccagtactatgttgaataacagtagtgagagtgcacatccttgtcttttctggttcacaggggaatgcttctagcttttgcccattcattatgatgttggttatggggttgtcatagaaggcttttattattttgaagtatgttcctctgatgcctagttagttcaaggtttttttcttttttttctttttgagacagagtctcgctttgtcacccaggctggagtgcagtggtgcgatctcagctcactgcaacctctgtcccccaggttctagtgattctcctgccttagcctcctgagtagctgggattacaggtgccaaccaccatgcctggctaatttttgtatttttagtagagatggggttttgccatgttggtcaggctggtcttgaacacttgacctcaggtgatccacacatctcggcctcccaaagtgctgggattacaggcatgagccaccgtgcccagccatatttatttattttcatatgttgaaccagccttgcatcctagaaaataagactacattactgtggtggataagctttttgatgtgctgctggatttggtttgcaagtattttgttgaggatttttgcatcaatgttcatcaaggatattgtcctgaagttttctctttttgttgtgtctcttccaggttttggtatcagaaaaacactgccttcataaaatgtgttagggaggcttctctttttctagaattttgggagtattttcaatataattggtaccagctcttctttatatatctggtagaatttggctgtgaatctctctgttccagggccttccttgttggctgtttttttaaaattactggttcaattttggaactcattatttatcttctcaggtattcaatttcttcctggttcaatattgggagtttgtgtttccaagaatttatccattccttctagattttctagtttgtgtgcacagaggtgtttacaatcatctttgaaattttttgtaaaaaatatttctcttccctttggcatttctgatggtgcttatttgaaagttctttcttttttttctttgttagtcttgctagcagtgtatcaatcttatttattctttcaaagaacaagttgtttggtttcattgatcttttatatggatttttgtgtctctatttcattcagttcagctctaattttggttatttttgtcttgtgctagtttaggggttcacttactcttgtttttctagttcctcaaggtgtgatgctacattgttaatttaagatatttatatcttttcgatgttggcattttgccccataaactttcctgttaatactgctttacctgtgtcccagaaattctggcatgttgtatctttattttcattaatttcaaagaatttcttgctttctgtcttaatttcattctttactcaaaagacattcaggagcaggctgtttaatttccatgtaattgtataattttgagagatcttggtattgatttctatttttattgcactgtggtctgagagtgtgattggaatgatttttaaaaatttgtttagaattgctttatggccaagtgcatggttgatcttagagtatgtgccatacatatgcagatgaaaagaatgtatattttcttgttgttaggtggagtgttctatagatatctcttaggttcatttggtcaagtgttgagtttaggttcggaatatctttgttagttttctgcctttataacacctttagaggggtgttgaaatctccactataattttgtatttatctaagtcttttttgtaggctctaagaacttattttctgagtctggatgctccagtgttggatgcatatacatttagatagttaatcttcttgttgaattgaacactttatcactttgttacaccattttttgtcctttttaattattgttttaaagtctgttttgtctgaaataagagtagcaacccctgttcttttttgtttttcatttgcttggtagatctttccttatgcctttactttgagactatgagtgtcattgcatttgagatgggtctcctgatgatagcatacagttgggtcttgcttctttatccaatgggctactctgtcccttgtaagtggggcattaagcctgtttatattcaagttataatattgatatgtgaagatttgatcctgccatcatgttgctagctggttattccacaggcttgattgtatagttgcatatagtgtcagtggactatgtaattgtcttttctgtggtgtcaggaatttttttttttttttgagaccgcgttttgctcttgttgctcaggctggagtgcaaaggtgcaatctgagctcactacatcctctacctcctgggttcaagcgattcttctgccttagcctcctgagtacctgggattacaaatgcatgccattacacctggctaattttgtatttttagtagagatgggatttcgctatgttggccaggctggtcttgaactcctggcctcaggtgatctgcccacctcggccttccaaagtgctgggattacaggcgtgagaaaccatgcctagccaggtaatggtcttttgttgccatgtttagcactctcttaaggactttttgcaaggcaagtctggtggtaataaattcccttaacatttgcttgtctgaaaaagattccgtttctccttcgcttatgaagcttagtttggctggatatgaaattcttgattggaatttttttctttaagaatgctgaatataccagcctggccaacatggtgaaaccccatctctactaaaaatacaaaaattagccaggcatgctaatgggcgcctgtaatcccagctattcgggaggctgaggcaggagaattgctttcacctgagaggcagaggttacagtgagctgagatcatatcattgcgctccagcctgggtgacaagggtgagactctgtctcaaaaaaaaaaaaaaaaaaaaaaaagaatgctggctgagtataggtccccaatctcttttggcttataaggtttctgctgaaggttctgctgttatcctgatatcaccccctttgtatgtgacctgtccctttgctctactgcttttaagattttttctttcatgttgaccttggagaatctgacgacaaggcgtctggaggatgggtgtcttgtatgttatatctctggggttctctgaatttcttgaatttgtatgttaacctctgcagcaagattggggaaattttcaggaacgatattcataaatgagttttccaagttgcttgctctctctctttccttggggatgccagtgaattgtagatttggtatatttatataattccatatttcttggagattttgttcattaaagaatatctttttctttatctaactgagttgatttgaagaactggccttcaagttctaaaattgttttcagtttgatctgttctgctgttaatactgcccattgtattatgaaattcttgtagtgagtttttcagctctaggagatcagtttctcttcttttctttccttttttcttttctctcttctcttctcttcttttctctcagagtctcactcggttgcccaggctggagtgcagtggcaagatatcggctcactgcaagctccgcctcccgggttaatgccattctcctgcctcagcctcctgagtagctgggattacaggggcccgccaccatgcccggctaatttttttgtatttttaatagagacggggtttcaccgtgttagccaggatggtttcgatctcctgacctcgtgatctacccaccttcggcctcccaaagtgctgggattacaggcgtgagccaccgcgcccgaccctgattctttcttaaaatggcaatttcatctttcagctcttgtgttattttattgatgccataagttccttagactgtgtttcaactttcccctgaatcttgatgatcttcattgacatctgtattctgaattccatgtctgtcatttcagtctggttatgaaccattgctggggagctagttcagtcatttggaggtaagaagacactcttgcttttagagttaccagagttcttgcattggttctttctcatctgtgtgtgtgaagttgttgtcctttgtatggagctttttacttttatattctttgatgccttttgtggtttgattgtggtattagttgtgcttagttaatttcattcgtttttggatgatttcaggggtccaagggttagctcagcactcctgggctgcatgctgtaccaggctgtaaccttgggaaattgggaccaggtctgaggcggttttctctagcccctagaggttaagtacctcctgggttggaaggaatgaggtgttcctggtccactggcaacaaaactgtgctggcaaaggcactttggcggggtggcagtgggtcagtgagggtccttgtgctcacatacgtgctggtcgtggggtagtggcaagtcctgcacaggcatgcgtgctggtggtggggcagtgatggggtcagtgtgcatgcatacaccagtgagtcagtggctggaggctgcaggcaaaggcatgacagcaaagcagcaggtagaggctgccagtgagtgcatgctggtgggcgctcactgacagggacctgccttcaggagctctccagctgttaggcagggtctgccatcaaaatagcaatggctgtggctgtcaaaaaatgccttggctgggcagctgaggcagtgctgcaagtttgtgtagccaggcagggaatttggcataggccagcagacaagcgagtgcttggatcagattgttcccatcccacaagcaagagagccctgtgatgtccaggtctgtccatcaacaaaggcgaaagccacctagagatgtatgatatttgggggatgggcacccatgccatgctctgctgtagccattctcatgccaaaccctgtggactctgtgcaggctagaattctgtctctttcaactctccaggctgttctccctgccaccttaactgtccatgggggatgaggggtctcctgcagctaagattctggaggtctgtggtgtgagttggccactccatgaccatttaacttactccttccccaggagcctctccaggccaggaacaagttctggtgcttggcaaccctgtgcagggttaccagcttccttccctttcagcctggggtctgcattctccttccatcaactctcaatgccttctttctgaaaatttgttcagagtgtgccagtcttcttgatggtctggtccctcactgggagaaggtcttcttgtctgcgtctggtcggccattttgttttagtatttattaaataatgaaataataataatttgaaaaaattaaattattattatttaaaactctagatcttatttaaattttctatttaaccatgcctcagcagacattgtgatgcagagggagggggatgtatgaaggaattgcctcatttcccactcagcttcctttgatgctcaggtgagggactaatgctcattactactgcatggaggttaggcctcttctgataacactctggctgaaggtactttgttactgctccccttttggcctccactgacatcatggggtagtgatttcattactgcttcgcagtggtgaaagacttgacttcccactacctctcctcagacatggttctagtagatggggagagttattcctcattactgggtggtagttcatgcttcccactcagcatattcttttttttttttttttttttttttttgaggtggagtctcgcttgttgcccaggctggagtgcagtggtgccatcttggctcactgcaacctctgcctcctaggttccagcaattctcctgcctcagcctcctgagtagctgagattaaaggcatgtgccacgacacctgactaatttttgtatttttagtagagacggcgttttgccatgtttgctaggctggtctgaaactcctgatttcaggtcatccacctgcttcagccttccaacgtgctgggattacgagtgtgagccactgcacctggtgcctattcagcatattctgacaccaatctagtagggaattgggccttcttacagcctggtaagcatggaagtcttttcagttgggatttattgtcttcctggatttgctgttttcccaagttgtcctcttattgattattttactagggagagcaggattttcttggagccttttaaaaaacttgcacttgttggcaggttgccaggttgctggcttcttccaagtccatgatatatgaagcaaaaaaaaaaaaaaaaaaaaaaaaattgagagagctcactcttgtatcattccttttgtcctgcatttctgagcccacctgtcgtcttctctctaattttcagagtctttttatgtttgttttatttgtaatgcccaggtatttttttgtttgttttagccatatttagctggggaaaaaagaataagtaagtctgtcccatattggtctggagcgtttacatatttttgaagccgggttttgttttccagtgtttggctattgccaccaattttgtgcctttggtggatacaaaaattttgacctctatgtcttcatgtgcatcactcacaaaatcatggagggggccaataactggttccttctgtgtgtcactaaatgctttcataattttcattttgtgatttgacagaatttttgtttaatgtgctttctaagccctatagttctcttcagaattccatgttactctgtgtgctttctaatctgtattcataaaatggtaccattaatttctaagatttttttttacaatttttaatgttattcctttcatgctttcgcatgaacactatctgtattgccttcatttgctccacctcatttaattccctgttggcatcactatagttctttcccaacttttacctttgggttagtcgttttagcaatgttcagtttgctacattaaattcttttattcagttgacctttgtttatactctggcaaatgcccaagtttagactcacttcattttgtttctttttctgtgtttcctaattgctcctggaggaacacacggaacaaagtagattggtcccattaccacacactactaaaaattccttcctaacaattgaaattgattctgtaattcaatctcctgaaatgaattcaacttaaaagatgacttgaaaatatacttgatccttgttatttgcagattccatatttgcaaattcacctactcactaaaatttatttgtaacccccaaatcaatactcaaggcacttttatgatcattcacaagcatgcacagagtggcaaaatatcttattactcaatgagcatattcttacctgaggttgaaaaatgtgatactgtgcctttttgtttcagttctcattctgtaaacaagtgtcttttcttggtctacatagtgctacatttttcacatttttattatctttgctggcgattttgctgtttaaaatagtccccaactgtagtgccaaagtatagtgcaagaaggttgtgatgtgccatatggagaaaatatgtatatttggtaagctttgtttagttataagttttagcggtgtttactgtgagtttaatgttaatgaatcaacaatgtatattaaatagaacgtctttaaacagaaacacacacgaaatctgtttatgtcttgagcagttgacaaaaatgtgaccagagtctcctggaaaaccaaccctgtatttctcctaagaacaaggactcaacagtcattaattcagcatttgtggtgacttcacagaacacgactaccatgaataatgagaataacctgtattttatttgtcttcttgacggtcatggaatcattgatggtttagatattatgctagaccttcttttgtcctaatcatcatcatcctacttgcctccaactttcctgaaactgttgaaaacatcgtgcacttttacatttatgatcatccattattttctttattcaactatctcggtttctatagtctctatagtaatgtccttcctaaaaatttcagagaaacagatgtatgccctcttaatcttttattttataatttttattataaaaatttcaatggtatgcaaaaatagggaggataaaataatgaactttcatgtactcatcacctagttcaaaaatttacaactcatggccaaccttacgttatccgtacataccctgataaaatcccctcatcccctttccctaccaaaatatcaaatctattttgaagttaatcccagatgttatatactttcatctgaaaatgtccccattcaaaaatactattttgatggtgatattagaggtacacgctttacaaactttgtgagctacagaagagaagccaaatttgccctatgattacaatattctactttcttatctctgggaagacatggcacccatttttttgggggggagggatggagtttcatgcttgttacccaggctggagtgcagtggtgtgatctcggctcactgcaacctccaccttctggatttaagctattctctcgcctcagcctcctgagtagctgagattacaggcaaccgccaccacaccagactaatttttgtatttttagtagagacaaggtttcaccatgttggtgaaaaattccttcctagcttccaggctggtctcaagctcctgacctcaggagatctacctgcctcagcttcccaaggtgctgggattacaggtgtaagccatcttgcccagcctccatttaaaaaatgttcatgtctagcatccacagtttttaccacttgccttgctctttatattttaatatcacaaaaaccactaataacctcatatgtaaaaatttttccttgaatctcctactgtttctcatctcagtggtatttggcgaccttgcctttcttaagacatatcccttgtttgaatttcataattctgaaatttgctgatttctttcctcctcctccatctactcatttctggctgtatcctttgattaatctttctctctctctctcaatctggctatgctcaagattcagatctcagataaagtttttatctgctgtctatattctcactcaaagaagccatcttttctttgaactcagctatcaccttaatgagtgccaaacctgtgtctccagaattcaactcttgcccatatttagtcttacatttctacctacttcaaagtgatttctatttatatattttaagttcttaataggaaatgaaaatttgtatatgtgccatttgaaactcaacaggcatcatgaaatgttgcctgggtttttaagtttctcgctcatattattagggttcactattagagttttttttactcttatgtttcctccacatgtattcagttaagtcctagactattttcccactttaccatatcttttatgtttatttcttatgcccctattatttctgttaacaccctaatctattccctcatttctttgtgtcttaatacttccacggcttcctgtttggcttcttccaattttagaagtttctgaatacacttcctgttctgtttctcactaaaccattcactaaaaataacaggattaatgagacaaatagagatagagacagactggtccctcaaaagctatgcaactttataactgaagaattaacaaatataataattggtacctttaaaaatagcttgcacagtgtaggcaggcaaaacgcccaaagtctggtggcttactcagggcatgttaaaaatgcaaagaaaaataatgtggaaacacaggtttgctggtgctaaggcaatatacacagggaagtgtagtcctgagcagaagaggaaatgcaacctaaaactgatacaaagctaggatacatctctctggggagggagttttgggtacaggcactcaggcattttcttaaaacagtgccccaaatgtgtctgcctgtgtaatagctgagttgaaagggttttccttttcttctgaagtttataattccactcccattattctggctcccttgcctaaaaaaaagcatatctaaaccatcataatttccatcttctactgacataactctgccattcactaatcaaatgtgagctaattagtgctggtagaatagactctatatttttttctatttgatacttgctggacatcaccttacttttcagcttgtaatgctatttactgctatttatatactattatttatattatttactatttgtatactgctatctctttaaaataattatttattctcggactcatttattcctgtctcttatgctgattaaagctttgttttctcttgtatcttctatttctctatcctgattttctctgcctgcatatagacttgggattttattatcaaaattatttatttttgaatagcttcatatggcatatcttatttctataagcagattgcaggtttctagaggacaagatccatgtgtttataatactctttttatatctcctcctacatacgagggtatcagtaaatgcttattggttagttgatttaaaatcacaaatgtattatttcaaatttactattatattagttaattttttaaatggacaaaagaaaattcacaaggaagttagcataacgtagggaaaaaagcatgggcttctgaattagatcgctctggattcaaattcggggtctgccactgattagcacgtgatctcaggcaaattacttaatgtttctgagtttcagttttcttagtaacccagaaaaaattaacctagttctatgttttttgtaaacaagaattacatgaattaatgagataatattttaatcaattaagaacttcatagagtgagtatgaatacttaatgggtggtcaataattagaagcgccaggatcttgaggaataatcagccagtacctcattattacaagccatataaagaatcaaaactctggagtttgcaggatataaataatgagaatttgtgattttatatatgcatttcctaagttctgccttttgctagactaagcactttacattcactgtcttacatcatcttcatagcactcatcacaggtaggtattattaggagcatttacagataaataaattaaaggtcttagccagcatggaaaggccaaacttgagatagaaaccctggtgtctgactctaatgtctgtttttttttgtttgtttgtttttttaaaatcagtaatagactcttcactcccttttttggggggttatgttacactaataaagagtatagacaaaataattagggagttattttgtcagatgtgtcacataagttaagagtacagttcttcaaagagatggaggcttcaatctcattgttttgaaggtttcaaggtatttcaaggtttcaaggtttcaatctcatcagttttcaaggtattggaggtcctcttttaggtggataactgacatagatggagaaaatcacttatgcatgcgaacacacggaatacttttgaaaattacccctttcattacattcttaagttagaaaaatagccaattcctctgtaatgaactgaattatgaattactaatttctgtcttctcctttagggtgactctggaggaccactggttagttcagatgctagagatatctggtaccttgctggaatagtgagctggggagatgaatgtgcgaaacccaacaagcctggtgtttatactagagttacggccttgcgggactggattacttcaaaaactggtatctaagagagaaaagcctcatggaacagataacatttttttttgttttttgggtgtggaggccatttttagagatacagaattggagaagacttgcaaaacagctagatttgactgatctcaataaactgtttgcttgatgcatgtattttcttcccagctctgttccgcacataagcatcctgcttctgccagatcaactctgtcatctgtgagcaatagttgaaactttatgtacatagagaaatagataatacaatattacattacagcctgtattcatttgttctctagaagttttgtcagaattttgacttgttgacataaatttgtaatgcatatatacaatttgaagcactccttttcttcagttcctcagctcctctcatttcagcaaatatccattttcaaggtgcagaacaaggagtgaaagaaaatataagaagaaaaaaatcccctacattttattggcacagaaaagtattaggtgtttttcttagtggaatattagaaatgatcatattcattatgaaaggtcaagcaaagacagcagaataccaatcacttcatcatttaggaagtatgggaactaagttaaggaaatccagaaagaagccaagatatatccttattttcatttccaaacaactactatgataaatgtgaagaagattctgtttttttgtgacctataataattatacaaacttcatgcaatgtacttgttctaagcaaattaaagcaaatatttatttaacattgttactgaggatgtcaacatataacaataaaatataaatcacccatttgcttgacattatgatatgataatccacaaagaaggggaagatgggaaaaatgttactagtcaatttattgtaaatttttttaaaatttgaggctaggatgaaaattaatttaataacaatcagcatgcttatgtactaaaataattgtgttgtggaatgggagggaacgaagagttcaaacaattgactggaaaggttttattcatctaagactttcccaaacagcaaatccttgaagggaatgagatccaggtgttagtgtacagtctagtcatgcaactgaactggggctcagacctctattttgagatgattgtagatatttttcttcccctgctgctgtgtttacagttcatacatggttaatggtcctgttagactcctcttcgctgagatggaaagataccatagagaaaatatcctggaagctgcctcactgctgcatctagtgtgacactgaatggctaactgcctggataacaaaactgaagagtaaaagcatgatattggccaccttcatgatttttagttttggtaaattattactgagctgttagagacacagctttcaagtaatccagaccgtaatgaagttaggactggtaccatgatgtacggcatgttaatggtgagatttcaccaagtctgtcctcattgcatatagctactcatataagttctatattgtacaataattaccctgaaaaccagtattgccacgaaaaatttaagtttattgatctgaataacactggagtatgaactgataacatttaggcacttggcaaaaatatgaaaactgacatgaattgatagtgctaaatattttgcataagctatttttgtttcatttagcaaaatgctctgggaaaaaacaaaattgaggaaaaccttgaattttaagcaaggatataagtacctttaaaactactctcagtgttctgttaaaaatggattcctcttgtttcagtgtattctgtagttgggcctctaggtggcacccacaagctgtaggaagctatggggaagcctgacatcaagaaggatgtctagatctgtaagtaataatgagaactgtacctgaaattagagtctcgtgaaaccaaaagaatacagtttttctttgcaaatggcgtttaaaaattaattcgtgttgatttacatcattattcgtatttttcaaatttctggacatttgattccaaactaaaataaaatttatgttgcatgatttgaggaactccctctgcaaaagcacctggagcaatttaaattaagaagaaattttaaaagcttaattttgcaatgacatcttattcctaagagaaatacttttgatatttccttctacaaaggatttgagaaatagaagtttgggtcaaagtgaaaatatgagcgatagttcaaactttatgtacatagagaaataggtaatacatttctaaaatggtaacttcttttgaaaagtaattaccaaagggttttatctgcatgtctgtgttaactgtttcattggagatagttaagaagatgtgacgataatatttattacttttttcaagagggcaggcagttcctcttctatatcttcgatctctcttcctacagcactagtaaagtactctgtatataacagtccttcaataaatgttgttgaatgactcttttatttttacattatgcagaaaacatagctttattattatttacacattgatttttaaaagtaatcccagattttacactgagtgaattaagccggttactatttatctaagcctataatctcacccgtaagatagagatgatatttgctcaaatgattgttgtggaaataaaactgtgaatgtttaaaaagtgcttagcacagttcttggaacattagtaggtgttcaagagaccatagtaataataactgttgctataatgaaactacactcttgttttaaaaaatatggtatttgattataacaggctgaataccttttttttttgaaatgacaagataattagaccaacaaaatgtgctagttaaaaaaatttctgattctacaaaaagttttactgggataattccgaaacatatttatcaaagtggtctgtcaatgtgagggttcattctaacttttgacttcaattttaaaaaatgataaactttattaaccaccgagtggctggattatatcaagatctatggtgtagttcaaatgtcgcctcttccctgaagcctttttttacttcctcaagtggatgtactatacgtttcttctgaacttccttaccattaattttttttattttcagataatcattgattcagatacggttaagatataactgtaagatataattcacagagattctgtgtaccctttactcagtttacctcaatagtaagatcttgcttaggtgtagtataatattacaatgaagaagttgacattgagacaatccattaactttattaggatgcaatcaattatatatgtgtgtgtaggtgtgtgtgtaattagttctatgtaatttaattacatatgtagattcatgtgattaccaagatacagatagtttgttcacaaggctacatcacgctaccgacagccatccagctccctccctaggcctgtgtctagtctctaatccctggcaaccactaatctgctctccatctttataatttttattgtttcaagaatggtatataaatatattatacaatatgtaactttttcaggttggctttttcgctcagtataattttcttgagatctgtccaagttgttgtgtgtgtcagtagttaattctttttttattactgagtagtattacatgatagggctgtacctcagtttgttaactgtatacccactgaagggcatttggattgttctcaggttttggctattacaaataaagctgctatgaagatttgtgtgtaagcttttgtgtggacataagttttatttttctgagatttatggcctagagtatgctgggtcatacggtaagtacatgtttagatttttaagaaacggccatattcttttcacatggctccttactacttgtaaaactctctgtacttagaatatctacctgtgtatttcacatgtgcagacagatgtgatttcaacaactagactgtaaactccatgagggtggggacactaactggttcatttttatatccttcacagttcacaggaaactataatattgtttatggcagttgttctataaagatttattaaataaaaataaagagtaataaaagcaaacaaataaatatacgtgaaataaaaaagaagaaatggctttgggtagaaaagaatgaacagtatttccttcatgaaggtattactgctcaatttctgtaattctgcatggactctaccatggcacttccatgtatcttatgttggttgatataaagtctgtttttcacctttccacagggtacacaatcaaacatagactaaagacatggttgatatggagaatctttatacctgaatttagtttctgatacatgttatatttaagagttttctgacacatctgtatcagcttctactgtatttgtggaatggattccagtttaggagcacaatcaataaatatttgttgctcttactttttataactatgattctataatttgtcctaatgtaatttttattatataactcaaggtggagtgaaagacagagacctgtgaaatgtaatcagaagttctctcttaattgtctctaacacattaatcagtacctctttggcgtagatgtagtcagcttaaattttacaatcactgtactcactgccttgcatatacccctcacctgcttgttctcttgctccaccactctgtgacacttgctttttactatgatcctggtaaaatttaactctccacttactgtttttaaaaactaattaatttcccccaattttattaaagtataattggctaataaaaattgtatatagttacagtgtaaaatttgatgttttgatatatgtatacattgtgaaattatttaatcaagctaattaatatattcattacctcaatacttactattttttaaaagaacatttaatatctattcagcaatatctacttttaacaatttaaaaatactcaatacattattattaactgtagtctccatgctgtaaataggcctccagaacttatttcttctatataactgaaactttgtaccttttaatcaatatcttctcatttctaccacactccagcctctagcaaccaccattttactctctgcttctattagttcagctttcttagattccacatataagtgagatcatgtagtaatcagcactctgtgtttggcttatttcacttaacataatatcctccagattcatctatgttgtcacaaatgacacgattcccttcgtttttaaagctgtatcatattccaatgtgtgtatttctttattcttccaccaatggacatgtaggttgattctatattttggctattgtgaataatgctacaataaacatgagaatacaagtatttctgtaccaaaagtgaaaaacagaatggttgtatggtacttaaagtatggtttctactgaatatttcaattaatcactgctgagataaccaaaatagtgtgtaaaaaacaagcaaatcagcaaaaccaaaattgcactttttcaaaatgtcagataaatgactaatcttttaactagactgaactcccataaaggagatgattcacattttaataataaagtcagatataatagtaaagacattattaccaatcatacagaaataaaagaattataattgtatattaggagcactggtatgtcaacaaattataataacttaaatgaaatgaacaaatctctaaaagacacagtcatacagactcaagagttctaacacaattccattatgttcaaaggacacacttcgtatgatttcagtacttttattgagagacacggcctagcaatggcctatcttggaaaatgttaatgtacttgagaatattatatacagtcatgcattgcttaacaacagggatatatgaactgcattgttacatgattttgttgtgtgaacatcatacagtgtacttacataaatctacagggtgtagcctactacacacctaggctgtatggcataatctattgctcctaacttacaacctgtacagcatattactatactgaatactacagggaattgtaacacagtgggaagcatttgtgtatttaaacataactatacgtagaaaagttactgtacaaatacaatcatctaaaaaattaaaaaatggtatacctgttaaaattcttatcatgaatggagttttcagggctagaagttgctctgggtgagtcagtgagtgagtggtgaatgaatgtgaaggcataggacattattatacactaccgtagactttataaacaccatgcacttaggctacactaaatttgtaaacaattttccctcttcaatgaaaaatcaactttagcttactgtaacccttttaatttataaactttaaatttcttttactttttgactcttttataatagcacttagcttaaaaacaaacatatttttcagccatacaaaaatattttttctttatacccttattctataagctttttaaaatattttaataatttattattttttacctttaaactttttggttaaaaactaagagcccaccacagctcagcaaggccactgtggccagactgactctctagattccctcctctctgggcagaacatctctgaaaaaaaggcagcagccccagtcagggacttatagataaaacccccacctcctgggacagagcagctgggggaaggggtggttgtgggcacagcttcagcagacttaaatgttcctacctggcagctctgaagacagcagtggatctcccagcacagcgttcaagctctgataagggacagcctgcctcctcaagtgggtcactgacccccgtgtatcctgactgggagacacctcccagtagaggccgacagacacctcatacaggagagctctggctgacatctggtgggtgctcctctgggacaaagcttccagaggaaggaacaagcagcaatttttgctgttctgtagcctccgctagtgatagccaggcaaacaggttctggagtggacctccagcaaactccagcagacctgcagcagagggccctgaatgttagagggaaaactaacaaacagaaaggaatagtatcgacatcaacaaaaaggatgtccactcagagaccccatcggaaagtcactgacttcaaagaccaaaggtagataaatccacgaagatggggagaaacaagtgcaaaaaggctgaaaatccaaaaaccagaatgcctcctctcctccaaaggatcacaactcctcaccagcaagggaacaaaatgggatggagaatgagtttgatgaattgacagaagtaggcttcagaaggtgggtaataacaaactcctccgagctaaaggagcatgttctaacccaatgcaaggaagctaagaaccttgaaaaaaggttagatgaattgctaactagaataaacagtttagagaagagcataaatgacctgatagagctgaaaaacacagcaggagaacttcatgaagcatacgcaagtatcaatagctgaaccaatcaagcagaagaaaggatatcagagattgaagatcaactcaatgaaataaagcaagaagacaagattagagcaaaaagagtgaaaagaaaagaacaaagcatccaagaaatataggactatgtgaaaagaccaaatctatgtgtgattggtgtacctgaaagtgatggagagaatggaaccaagttggaaaacactcttcaggatattatccaggagaactttcccaacctagcaaggcaggccaacattcaaattcaggaaatacagagatcaccacaaagatattcctggagaagagcaaccccaagacacataattgtcagattcaccaaggttgaagtgaaggaaaaaaatgttaagggcagccagagagaaacgttgggttacccacaaagggaagccaatcagactaacagcagatctctctgcagaaaccctacaagccagaagagagtgggggccaatattcaacattcttaaaaaaattttcaacccagaatttcatatccagacaaactaagtttcctaagcgaaggagaaataaaatcctttacagaaaaggaaatactgagagatttttgtcaccaccaggcctgccctacaggagctcctgcagtagtttctgctgccttttgttcagctatgacctgccaccagaggtggagtctacagaggtaggcagggctccttgagctgcagtgggctccacccagttcaagcttcctggctgctttgtttacctactcaagcctcagcaatggcgaatgcccctcccacagccagtctgccaccttgcagttctatctcagactgctgtgctagcagtgagcaaggctctgtgggcatgggacccgctgagccagggccgggatataatctcctggtgtgctgtttgctgagaccattggaaaaggtgggagtgtcccaattttcctggtagagtctgtcatggcttcccctggctaggaaatggaaatcccccaaccccttgcacttccagggtgaggtgatgccccaccctgcttcagcttgccttctgtgggctgcacccactacccaaccagtcccagtaggatgaaccaggtacctcagttgaaaatgcagaaatcacccatcttctgcattgatcatgctgggagctgcagaccagagctgttcctatttggccatcttggttcttcactatagacatgttacaaaggaagatatacaagcagtcaacaagcatatgaacaaaaagatcaatatcactgatcattagggaaatgcaaattgaaaccacagtgagataccactgatcattagataaatgcaaatcaaaaccacagtgagatactatttcacacaagttagagtggctataattagtcaaaaaatagcagatactggtgaggttgcagagaaaagggaacacttatacactgttggtgggagcgtaaattagttcaaccattgtggaaagaggtgtggtgattactcaaaaagctaaaagcagaactaccatttgacccagcagtcctgttactggatatatgcccaaaggaatatatatcattctaccataaagacacatgtacatttatgttcattgcagcactgttcacaatagcaaagacatggaatcaacctaaatgcccatcaatggtagactggataaagaatatgtggtacatatacaccatgggatgctatgcagccataaaaaagaatgagatcatgtcctttgcaggaacatggatggaactggagaccatcatccttagcaaactaacacaggaacagaaaaccaaatgctgcatgtactcacttatgagggggagctaactgatgagaacacatggatgcaaagagacaacagacactggggtctacttgagggtggagggttggggagaagaataggatcagaaaaaataactattgggtcctaggctttgtacctgggtgatgaagtagtctgcacaacaaactcccatgacaggagatcacctatattagaagcctgcacttttacccctgaacctaaactataagtttttttttaaaaaaaatcttaagaaagaaacataaagtcaaacgttttgtgaatattatgtcaaaattatgtgcttatcattttgctgctgttccttttttaaaaatgctttttttatctctctgtaaaataatggtgttccctttctaatgcaaacatactttcagatcctaatcattggggtaaacattctttttaaaactattgtttacaaaagtaaaaatctgactttgtccatgcagatcatctattgacaagtatttttcaacaacataattttaaccttatgacatcagttttaatagcagtcattacactattattccaggtgattctgggacacctgagtactctgtgtaattgaagttatctgtagccacatttaatatgacatgttcaatgtttggtctcacaagctcactgcttagagtcttcttcatccacccaatattgaagtaatgaaatggctgttaatagattcatcactgatctcattctgcgacatctttatcagaataatataaaatcaatgtaagaaatttggtgaaattatgaaaatttaggaaaaaataaatttcatttataaaatctgtgtgctttcattatggttttattctatttatataactcaaagtacatatattatgtttacataaaaattttttatctcattgcatgtatcttttcttctgacacaaaaattgtgatatttttctgttcatcattttgttccgtagtattcaacaatacctgtactatggctgacagtgtaatttaacattttttgataaaacaattgtaatgacatggtacacacattgtatacattttaaatcatttctcaatgtaaaatatttgaattgtctccagtgtttattttatgaatgtctgccacaaatattgaatctgaccatcgtgatttaggtgttctctgtatagtttcatatgagtatattatgaagccaatgtctatatgcatttttataatacttaatacttttccccaagtgtctgattcttttaaaatatgcaatcattatctgagaatctaatacataatggaaaagcaagaaaatttgtgacaaaaattattttatgtaagaaagaagtagaggacaggctgcacaactattgacctggattcgaacctaccttctgcaaatgaataacaacagctagtattagtatttatcactattgttctaatagtcattcttgcccttgtcttccttctccacctactctcttcccccttctaatggcaccatcactttcctctaatgtgaatgggaaaattttttgagaataaggttagagtgcatagaattttcattggtcttacctctgcctttgtcctttgggaaattaccacatagagcctatgcaattttcattcaacataaacattgagttttaactcaagtaagatttcagttttctgttgctgcttataagaaggtagacaaaaagatctcttaaggcttatataataaagtagtgaggaatgcttgctttctgcttatgtctcaaaagaataacattaaagtaaaatatatgaggttcttttgtttcttcgtaaggaagatcatcctatatcctgacagaattcttttgtaaatctcagtgtagttttcagatgcaagtggtagacattatttggatcttattatacatgcattgttcatttttttttggtgcttctctgtcaggcagctgtgatgatgagtcccaagtttcccagagatttttactgaggtgtcctataggcttggtataaggcagaaaacattaaaagggtaaactgacccttttatgctctaagatataaacctctgtcatctcactgactaatgttttaaatgctagagtgaaagcaagtaaacattggctttggctgtgaatattctggtggcacacatttatgtcgttgatgaatagtgtaccttgaaaagccttaacccttacgccgttagcatttcatcttgttcatctgactgcccaaacatctatatttaaacaaatccacaggggatctgttctctaggactttgctggagaaccttgatgtgtcggaaaactgttcctattaatagaggaattatatctcgagtggctggcatatgttaactaatggatactattaatagtaataacaaaaataaaaaatcattacaatattactactatttgaatcactgactatgtatgagagacattataagtgttttatctatgttaagtatatttccaacacgacacaataggaggtaattgccattattatagaagtaggcataattatctctatcaacattctagtccacttttccatcattatctgttgcataaactcatgcaaaatcttctaaatgatctacacttttcacaatctggcctttttgcgatgtaatccattgacaacattgagagctttttaaagaaagggaatctgataatatctctccatttctgaactctgtgcagtagctcccctttgcccttaatagatacttagatctccttatagttatattgcttcaacttacctctctagcatcatctgctactttactcagctttttcctgcatactaatttgaaaccttaggcactgcctttacttcactacctgcttttctttttgtgttttcctctccccctcatcttttcatctactcctagacattattgaggactcactttatcaatgactttgagatctcttctacatgtttccttagcattgtgaccttataacacttttagacttttcctttttacttgcttatagtctatctttcaaagtacaacgtaaggcatgagggagcagaaagtgcctacatttcttctctgaaaatccagcacttatccgtggtttgtgctgatcaattcataaatattccttgaaggaatgacttatttttttttttacattgcacaatgaaggctttcattgaatcaaccctgttttcagagtctctttagtatccctctttgatatttaatgacactaaagtttacacagttgtgatgatatagcaacatatgagtttctaatggtaggtcactttctttgacctcccgtatttctctcactgtgagtcaaacactctgaatgaaaacatatctggccattccttctgaaatgcaaagcaaataaatcaaacatgaatacatttaccttaggcagggttttggctggtttacagtggagttcccccacaaaatcgacatttggtaagggtgggtgaagaaattcaaaatcccagtacgtttgaatgagccacacttcagctttccccattgtctcaaataatgtacattaataaaataaatatatacatatatttttatatataagcataacaattttatatattgcatattacttatatataaggaaagcaaaatgttcagagaattaagaggaaattacatatatttttttctttttcttttttttattatactttaagttttagggtacatgtgcacattgtgcaggttagttacatatgtatacatgtgccatgctggtgcactgcacccactaactcgtcatctagcattaggtatatctcccaatgctatccctgccccctgcccctaccccaccacagtccccagagtgtgatattccccttcctgtgtccatgtgatctcattgttcaattcccacctatgagtgagaatatgtggtgtttggttttttgttcttgcgatagtttactgagaatgatgatttccaatttcatccatgtccctacaaaggacatgaactcatcattttttatggctgcatagtattccatggtatatatgtgccacattttcttaatccagtctatcattgttggacatttgggttggttccaagtctttgctattgtgaataatgtcacaataaacatacgtgtgcatgtgtctttatagcagtatgatttttagtcctttgggtatatacccagtaatgggatggctgggtcaaatggtatttctagttctagatccctgaggaattgccacactgacttccacaatggttgaactagtttacagtcccaccaacagtgtaaaagtgttcctatttctccacatcctctccagcacctgttttttcctgactttttaatgattgccattctaactggtgtgagatggtatctcattgtggttttgatttgcatttctctgatggccagtgatgatgagcattttttcatgtcttttttggctgcataaatgtcttcttttgagaagtgtctgttcatgtcctttgcccactttttgatggggttgtttgtttttttcttgtaaatttgtttgagttcattgtagattctggatattagccctttgtcagttgagtaggttgcaaaaattttctcccattctgtaggttgcctgttcactctgatggtagtttcttttgctgtgcagaagctctttagtttaattagatcccatttgtcaattttggcttttcttgccattgcttttggtgttttagacatgaagtccttgcccatgcctatgtcctgaatggtaatgcctagattttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttgtgttccattgatctatatctctgttttggtaccagtaccatgctgttttggttactgtagccttgtagtatagtttgaagtcaggtagcgtgatgcctccagctttgttcttttggcttaggattgacttggtgatgcgggctcttttttggttccatatgaactttaaagtagttttttccaattctgtgaagaaaggcattggtagcttgatggggatggcattgcatctgtaaattaccttgggcagtatggccattttcacgatatcgattcttcctacccatgagcagggaatgttcttccatttgtttgtatcctcttttatttccttgagcagtggtttgcagttctccttgaagaggtccttcatatcccttgtaatttggattcctaggtatttaattctctttgaagcaattgtgaatgggagttcactcatgatttggctctctgtttgtctgttgttggtgtataagaatgcttgtgattttggtacattgattttgtatcctgagactttgctaaagttgcttatcagcttaaggagattttgggctgagacaatggggttttctagatatacaatcatgtcttctgcaaacagggacaatttgacttcctcttttcctaattgaataccctttatttccttctcctgcctcattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgtgtatattgaaccagccttgcatcccagggatgaagcccacttgatcatggtggatacgctttttgatgtgctgctggattcgatttggcagtattttattgaggatttttgcatcaatgttcatcaaggatattggtctaaaattctcttttttggttgtgtctctgcctggctttggtattagaatgatgctggcctcataaaatgagttagggaggattccctctttttctattgattggaatagtttcagaaggaatggtaccagttcctccttgtacctctggtagaattcggctgtgaatccatctggtcctggactcttttttgttggtaagctattgattattgccataatttcagatcctgttattggtctattcagagattcaccttcttcctggtttagtcttgggagagtgtatgtgtcgaggaatttatccatttcttctagattttctagtttatttgcgtagaggtgtttgtagtattctctgatggtagtttgtatttctgtgggatcagtggtgatatcccctttatcattttttattgcgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttattttaattgtgatgttagggtgtcaattttggatctttcctgctttctcttgtgggcatttagtgctataaatttccctctacacactgctttaaatgcgtcccagagattctggtatgttgtgtctttgttctcattggtttcaaagaacatctttatttctgccttcattttgttatgtacccagtagtcattcaggagcaggttgttcagtttccatgtagttgagcggttttgagtgagattcttaatcctgagttctactttgattgtactgtggtctgagagatagtttgttgtaatttctgttcttttacatttgctgaggagagctttacttccaagtacgtggtcaattttggaataggtgtggtgtggtgctgaaaaaaatgtatattctgttgatttggggtggagagttttgtagatgtctattaggtccgcttggtgcagagctgagttcaattcctgggtatccttgttgactttctctctcgttgatctgtctaatgttgacagtggggtgttaaagtctcccattattaatgtgtgggagtctaagtctctttgtaggtcacttaggacttgctttatgaatctgggtgctcctgtattgggtgcatgtatatttaggatagttagctcttcttgttgaattgatccctttaccattatgtaatgaccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgggatgggtttcctgaatacagcacactgatgggtcttgactttttatccaatttgccagtctgtgtcttttaattggagcatttagtccatttacatttaaagttaatattgttatgtgtgaatttgatcctgtcattatgatgttagctggttattttgctagttagttgatgcagtttcttcctagtctcaatggtctttacattttggcatgattttgcagcagctggtaccggttgttcctttccatgtttagcatttccttcaggagctcttttagggcaggactggtggtgacaaaatctttcagcatttgcttgtctgtaaagtattttatttctccttcacttatgaaacttagtttggctggatatgaaattctgggttgaaaattcttttctttaagaatgttgagtattggcccccactctcttctggcttgtagggtttctgccgagagatccactgttagtctgatgggcttccctttgagggtaagcccacccttctctctgtctgcccttaacatttttttcttcatttcaactttggtgaatctgacaattatgtgtcttggagttgctcttctcgaggagtatctttgtggcgttctttgtatttcctgaatctgaatgttggcctgccttgctagattggggaagttctcctggataataccctgcagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtgttggttattctagttatacattcttctaaatttttttcaaagttttcaacttatttgcctttggtttgaatgtcctcccgtacctcagagtaatttgatcgtctgaagccttcttctctcagctcgtcaaagtcattctccatccagctttgttccgttgctggtgaggaactatgttcctttggaggaggagaggcgctctgctttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccccaccgtgtgaggtgtcagtgtgcccctgctgcggggtgcctctcagttaggctgcttgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtctgtgccctgcccccagaggtggagcctacagaggcaggcaggcctccttgagctgtggtgggctccacccagttcgagcttccctgttgctttgtttacctaagcaagcctgggcaatggcgggcgcccctcccccagcctcactgccaccttgcagtttgatctcagactgctgtgctagcaatcagcgagactccatgggcgtaggaccctccgatccaggtgcgggatataatctcgtggtgcaccattttttaagcccgtcggaaaagcccagtatttgggtgggagtgacccgattttccaggtacgtccctcacccctttctttgactcggaaagggaactccctgaccccttgtgcttcccaagtgaggcattgcctcgccctgctttggctcacgcatggtacgcgcacccactgacctgtgcccactgtctggcactccctagtgagatgaacccggtacctcagatggaaatgcagaaatcacctgtcttctgcgtcgctcacactgggagctgtagacctgagctgttcctattcggccatcttcggaaattacatatttaatgtaacattagtatattcacaatctcaaatagttattaaaataagccactatggacttaaatatgcatttgtttcctctctgaaactgcagtagtaactgatatacatttaaacagctctttgagctccaggatgaattcatcttactatactcataaaaacagctttctacgaagtgcacaatctcgtttccacaatttatcaagtcagtcccttgatccttggttctccaagtgaactgtgagttttctgagagtatgcctgaaatccttgaacatactactgcttctagttcacgttaagattttaacaatattagctttaaaatacatacattaaaaatgatagctagtatattttcagaatttattgaaacagagatatgtgctcccccttaacttggcccatattttccctaataaagagatgtagttaataaagtatagattaaaagcttgaatgttcactttcaacaagattttaattcacaaagcaaataatttctcagttgttagtgaatgatatacaaacactagaaacctcaaattttaggtttctgtttctgaaatagagccagtatacctctcaactgtgaaggaatccttctgtttatagagaaaaatattttaatacctaaataagaaaactgaggtacacaaagagaaacaagtttctcaatgctgcattgatagttatgctagaaatatgtgtagctcctcatctaaatgtctgccttcatcaagttgtttattgatatatgttttgccttttttaaagatgaaaaaagtatagtaaaatacgtatatagttgcttaaagaaatcataagtgctttactttgtagtttttttttttttaattcctgtagtgtcctataggagtgatgaccaaagggttctagctgagcctataatatcaacatttctataatatttgtgagattgatagatcatcttacatttggcattcatcatttcatttaaacaacactatcctcttacattatatttatatacgctcaccttcaaaggcaaaaggaaagttaggacttattaatcattgattagaaacatgacttacctagaacttcactgtaaaacttctcccacttctcgtatcaaacatttgaaaccaaaagtcaaaataaagcacatgtattagatttttaatcctctccacgaatgtcattttaccacttaattcagacagaacagcaggtatgcgggaaatggggaatggaagtcctccattatacttctcaagtgtgtagccaggagactgtcaacaaaggacatgtatttaacatgcctttaacatgctcagctagcagttcaccacaggcaccaagggcatctgcaagaacgacatcaaactttgactcttgtagttttgtcgtaattttcttgttcaaaactacatctttacagagattattaacacagtctgtagattcccaaaagagttcttgtgcttgtgaaaaatatgaccaaaatgcatcttttggaagatcgtatatccatctattgatcagtttcacaacaagaccctcaaaattatttttaattagagatgttggataaacttcaaatttaatagcagatgatttactagggtcaataataatggaagccgaagatgtcaacacagtcatcttgtggcctctccaaacaagttcatccaggattgtctttatattcatccaatggctgtattctgtgggccacagcagcacctttccacaactcccagagctaaagtaacaactgagttgtatcaggagaatatttgacatcgatttcaatgtcctcctggtgcaatgcaatgtttcttttcaaattgctgtttctttctgtctttctcatacttacatctgagcataaatcaatcaagtgaaagtataactgctacaattcaaagtagcagttaccatataatttctaaattatcataggaattgtctgttaccatacaatttctaaattaccataggaattttcagattgtttttcacagtggttgcttccatttccattctcaccagcaatgtataagaattttaatttcttcccaacattgccaacacttgggattacatttcgtttgattatagccagtgtgaatgaagtgatatctcattatgctttacctttccttgatatgaaatcatgttgagaatgttttgcctagttttgattgaattatttgtcttcttatggacttgtgtttttaatatttttgatgtaagaaccttatcacatgtatgatttccttgtatttttttattctttgggctgtccttttactttcttaatggtgttaattgaagcacaaaagtattgattttaatgaagtccaactaatcaattttaatttggttgcttttatttttgattttatatctcacaaaccatttccaagttatgaaaattagtacctgttatttattattagagttttatagttctagtgcttacatttaagtttttgatcacctatgaattagcttttgtaagtgatttgaggtagagggtcccaacttaattattttgtatacagataatcatttttcccacttatatttgttgaataatctattctttcccctattaaaacgttttgaaacttttgtcaaaaactttaaatgcatgggcatatttctatgttctaaaatcattccattgatctacatgtctatctgtaggcctgtatcacactctcttgattatcatatatttgtatttgtctttaaaggcaggaaatgtaagttttccagcttttttttatttaaattgtttcagttttttttttaatttttttcttcttgtttttttttttttttttttaagagatagaagtcttactatattgcccaggctagattcaaatttctgggctcaagcaatcctcccaacacagcttcttgagtagctggaattacaggtgtgtttcactatacctagcttcttttggctattagtatgtctcttgaatatgtacataaatttcaggatcagtttgtctgtttatacaaagaagcaatctgggattttgatacggattgcattgatttggtatatcagtttggggagtagagtatggtcattatcacaattttaggtctttcaataaatgaaaatgagatgcctttctatttatttagatgttcttatttccacagtgttttgtagattttgttacagtggctagctagtcagacacaaacagggcagaagagggctcccacaccctaccaggaaagtcaggtgaccatcagttaatggccaggcagttgtcacactgtttaaaacaataattggttgcagccagccagggaaaggcagatttcttatagatagaaaaaatcaaatctggtaatcagcagcttcctgataagatctcagcagttgggagagtgggttcacacacacacattaagaggccaaatggtggagtacgacattccgggggcaccagaaaagggaagaatgcctcaggggagcatgcatatgactccagtaaatatactgtgcatgctcatctcctaagtggtagcaggccatcacacatgccagcaggtcattctaaggaaagaatcaaggaaaagggaagcaggacccggaaagtatgccaacatataaaaccctaagtcaaaggtcaaacaccacactttaccttcaaaatggctacttgtatctatcccaagtgtactttcctttctttcctgctataaaactttttaataaattttcacttctgttctgaaacttgtgctggtctctttttctgccttatgccgctcagtcaaattcattcttctgaggaggcaagaattcaggttgctgcagaaccataaatacttgctgcagtaaccaccgctggtaataatgtcacagtaagagttgtacaattttttgataaacttattgctaagaattatattttttcatggtattataggggtgactgtgtaatctttattttagtttaaatttccattgcaattgtgtagattttttgtttgtttatttaccttgtatcccaaaatcttgttttattagtttacttgaatattttttagtggatttgtaaaaattttctattataagatcatgatatatgccaatagagacagtttaacttctttctttctaatgtggattccttttatttcattttctttcctatttgttggctgaaagttctactgcaatattgagtgaaagtgagaagagtcagtttagtgtgatgttagctgtgtgtttttttatagacactattgatcagttttagaatgttcccctttacttctagtttaagtgttcttatcatgaagaatattgaatttcattaagtaagtttttctgcagttatcgaaatgattatgcagttttttcctttattctaatgatatgatatattagttggctttttcagatgttaacataactttgcattcctggaataaagttcatttgtttatggcatttaagcttttcatgtgttcctgaattttgtttgctagtgtgaaaagaaagtaaaaatcttgagtcattaaactcactatgtcaaagagaaaagttaatcttgggaaatgaagcatgtaaaattggctcccattttgttcctaaacagatagctgcaaagatagaaggccacatacctccccagatggcctccttcccaatttactcacaaggaaattcacaaggccctaaaacagagttctcttgaattttaccctgacaatataaattaacattttatattcacaggtatataaaagacaggacttgaagccattgtgtggtttttagcataagggcttactgaatggtggttatgttttctcctcttttattttttggagaattagttattttaaatacttgatagaagtatagagcttttatattttctactctaccatttccagttattacccagctatgtttttctaaataatatttcattggaagccgtcagacactgggcttttcttttatgggagactttttcttacagcttcaatcttgttacttgttattagtttgttcaggttttttatttcttcatgggtctattttggccggttgtatgtgtccaggaatttattaatatcatctaggttttccaaattgttggtatatagttgttcataatattctgtaataatttgtgtttctgtaatctcagtttttatgtctcctctttcacttctgattttatttagtgggtctgttctcactttttcttacttagtctagctaacagtttgttgattttgtttacttttacagagtttaccttattgactatggctgcttttgtactacaatggaagagttgagtaggcacaggagtccaaagggtttgcaaattccaaaaatgtttaccatctgaggctttatagaacctattctgatctctgctctacagtaagcaggttcgttttttcctttaacctttctatatattcaatgcaattttactaaaacagtatagatttttagtgagtgagccagatggtttacgtttaattttgttaataattagttaataaattaatctatttgtatttccattttatttagaataggtgaatttgtttattatgtggaatggtgcttctgttttgccttttttttttgagaaatctctaaactgctttccacagtagttcaactaatttgcattccaccaacagtgtataagcatttccttttctctggatcctcaccagcatatggttttttttttttttttttactttttaataatagctgttatgactagtgcgagatggtctcattgtgattttgatttgcatttctatgatgattagtgatgttgagcatttttgtcatatgtttgttggttccttgtatgtcatcctttgagaagtacctgttcacatcttttgcccagtttttcatagggttacttgatttttgcttgttgaattattcaagtttcttatagattctggatattagacctttaacagatgtgtagcttgctaatatattcttccattcaataggttgtttgtttattctcttgatagtctgctgtgcagaagctcttcagtttacatctcacttgtgaattttgagttttgttgcaattgctattgaggacttagttataaattctttcccaaggctgatgtctagaatggtatttcctagattttcttcaattattcttatagctttaggtcttatatttaaacatttaatccatcatgggttaatttttgcatggtgaaaagtagaggtccagttttgttcttttccttatggctagcaagctatcccaccatcgtttattgaatagggagtccttttctcctttgcttatttttgttgacttagtgatggatgactataggtctgttgctgtatttctgggctctgtattctgtttcattgatttatgtgtctgtttttgtaacagaaccatgctgttttggtatctgcagccttatagtttgaagttgggtaatgtgatgcctctggctttgttctctttgcccaggcatgcttcagctatttggactaacttttggttttatggaaatttttgaatatttttttctaattctgtgaataatgacattggcattttaataggaatagcatttaatgtgtggatggctttggttaggatggttattttaatgatactgattcttccagccttgagcataaaatgttctaccatttgtttgagtcatctatgatttatttcagcagtgctttgtagttcttgtagaaatcttttgtctcctcggttagatgtatttttaagtatattttgtttatgtgactggtgtaaatgtgattttgttcttgatttgattctcagcctgaattcttattggtgtatagaaatggtattgatttttgtacattgattttgcatcttgaaaccctactgaagtcatttttcagttctagcaggctttaggcagtctttaggattttctaggtatagaatcatatcatcaggaaagagagataccttcaattcttttcctgtttggatgccttttatagctttctcttgcctaagtgctcaattagtacattattgaaatagaaagtgctgttattttaatcatttatatttgaaacataaaatttaaaaaatgtattagcctatgttaagtccaaattcattgcggaaatgtactcatccacctaataataataatagttgtagcaaattgaatattactatatacagcaattacttacagcaactcttttagcctcagcaatgctattaagtaggtagtgccattgcctcatctccatttcactgaaggagaatgtgaggcatagacctgataagtaatttgcttaaccataagtgattctgtaatggttttgcaaagatgatataggttatctggattcagagtgcaagctcttacccaccatcctatgctgactactctttctgggttacaggtagttacaaaatgtaacatagaatcacatttttttcgtacgtatatattaattataatattattacaggtgtatgattcaaatatgtaaaaatatttttctggttgtctatcactgcttaaccaactgctctcaaatgaaggtgcttagaacagcaacattttatcatcgcctgttttaattctaggttgttggccaggctcaattaggtgtttatggcacagcatttctcaactggttactgtcctaaggtagcttaggctaatcatctgaaggttaatcactcacatatctggtaattagtattaaaagtctcaagctactggagtgctggaccaattgtgacttcttaggcatacatatgtatttctacaccaaatggtatatttctcctggggactgtggatatggcacagggctccaaagtgagtggagagaccgagagaaaggaaaaaaaatgacagaaacacagagaaaaggacagaaggacagacagagaaaatgtattcacaacttttttgagctttggaagttaagctcctcacttccactatattctcttttttaagacagccacaaagtttgctaaatttcacaggaagggtatatgacttgattagaggattgccaatgcatttgtaatcacatcccaaaattactgcaaatataaccttaaaaattagaagaaatcactaaattactatagaattcataaaatgttgacataagacagtaaaatttaaaaaaattttgtatttaaattttaaccatgattaaaaattttaattaacattctaatatatttattcataaatatttaaaatatcaagtaggtgtccaaaaacaatctgtaaatttatcagatagagagtaccagattcctggtcaatttaagttttctaaatggcactaatagattgataatattatattaaaacctaagaacatgctatctcaaatcaatgtttatttcactaattaatttttaaaactatataattaaatataaaaacaaatttgtgcaaggttagtgaatgaagtatgtagaatcaaaattaaaagtagaatcctctatgtttatacagatttacagattcttaattttatttcaaagaagtatactcatttttttctggaacttgtttttcatttagcaatgtgatgtggagaacattccctgatattgtctgtaatatgcctgttctctgtaattacttcataccttctactttttgtgggaggtatgtatgtgcactgactgatagccatgtaagtgatggagggaacaacctgtacatacacgcactcaggtgcaagtgtatctggatagcagatgactagatgtagaattgcagagtcaaactctaagtataattttttttgtaagggttatttcactttatactctctcacaaactcttttctcaggttcttatgtttgatcaatcttctgtgggaaaataattcattgactttttatggctacatagtaatccatggtgtatacatactgcactttccttattcagtctatcattgatggacatttaggttgatttcatgtctttgctattgtgaatagtgttgtaatcaacatatatgtgcatgtgtctttataatagaatgattatattcctttgggtatatacccagtaatgggattgctgggtcaaatggtatttctgtcattaggtcttggaacagacaaccaaatgctgcatgttctcacttacaagtggaagctaaataatgagaacacctggaacacatgaacaacacacactggggcctattggagggtagaaggtgggaggggggagaggatcaagaaaaataagtagtgggttctgggcttaatacctgggtgatgacacatatttgcctatgtaacaaacttgcacatgtacccctgaacttaaaagttaaaaaagttcattgacttaacattattgacttaataaattataatgtccaattttctagtacaagtagcttttgtcatctttttgatgtgattggccatttttacttctgtgaattgtcaattcatatccttcatctattttcatattggtctgtttgtctttttggttggtgatatataatagctctcattgtacaagggataccagtcctttgtctacgtattgcaggataggcttgatgtaaattactttaggttggtatgcatgatgtaacaatattatctgctatgacactatatttattcaatatttcttaaaaatgtttcatttatctggatacattttataaaaattctgctgcaatctcttccaataattcccttagcatcaaagttttaatttatttttagaatacattcatgccataggtcatagagtggttgttgtgagacttggatgatggtcttcttgccaataaagacacaaaggtttttgttaacccatactactttgatcacaaagtgtttccttgatgtgtagcttttaggagggccttgagaattcctgagattttattatttgccatttttttggtaatttttgtgttcttgatattattactgattatgattagttgcaatatgtttacattaaaaatgattatcttatttttagtcatgctaaatgacttatgttttcatattagtgttatgggatgaatagagctacaggcttctgtggaaagagagaaacatgagacatccttatataaaatagggttatatagaataatggtcacttttaactgtcttctacaaacacattcagtttcacaaacatctgtaaggtagctcaataattctgtgccttgttttggaagaagtgaacacatatatacatgtacagttgtgataatcaaaatcggtaagtccccttaaagtgctggttctatattatcacaacctacaattcagacatttaatccactattaacgtttataaatgaccgtgaaagcaaccagttcacactttagaaaagttcatggggaaaagacaattagcttgtgaacaaaggttttcccaaatagttaaattttgtagtatttgtcaggtaggagtcattctatctctaatttgtcatatattgtgcttttgatccttgaacaacatggaggtttgaactgaacctctgattatatgcagattttcttttgcctctgccagcctgagataacaaggccaacttctctttctcttcctcctttgcctacttaatgtgaatacatgaagaagaaaacctttgtgatgatccacttccacttaataaatagtaaacatatttaaccttccttgtgattttcttaataacattttcttttgtctatcttactttattgtaaaactatgatatacaatacatatagcatgcacaatatgtgttaatttactgtttatgttattggtaaggcttctggccaacagtaaactatctgtagttaaattttgtggagtcaaaagttataaatggctttttgatggtgtgataggagagatttgcccgtaggtccactgctgttcacaggtcaactttactgcaaaatgatttaagttggcagaagccaaatgcactgccatatttttttagaaaagaggtgatgttgtagccggatgcacattaaggactagcagcattacttgtctccaaaccacagaggaatatggtggtcccagattttcagttttgttccccaactccatgtatctgagtcccattattttgctcttcaggccctaaatgtggcataaagtgtagtagaggcggacagtgtcgtctcctgtgcatcactgttgttttgcgatgaaattctcaatgtggtcagctgctgctgctgcagaagtcgattttcttcaaacactgccaagaacatctgacttacatagcatattttgatttgatatttattcaaactgagccttttttctttttacaagctctctgaaactgttaaaagtcttcactttataaactatgtagttaccatgatctttatactgttggtaaagcaatgattcactttccccgtgtctttcacctcagttcttttcttccctgtgtgaattgtatccattttgatcaaagtgattttactgaataccaggagttatcacctctcaagtgttgttggcaaggagactgtttttgccagttatcagtgagttattaaattccaaagtcccattttgagggtctgctttttagtgccacttgcccaagctgccatagtctatttttctcagaaagcaaagcctgagataagaattagtgtgcaataactaatttgagaaatgttcttagggtacaggagtaggggacaggaaagggtgaaacaagaagggagaaaagtcagtacaagaatgtgttaccaaactaatcatcaccgtgactgttgggacttaagctcatgtggacccagtaggaagctgtgtggatgtaaggcgtgatcattaaccatcactttctattgttcacactgccaggttatgcacatgtgagtgagtgttagctgagtttctttgacggttccatgaagagatgttaaagaagactggtgcagaaaatgagagacctgtcctatcagaagatgactttacaaagctccttgacacagcaaaggctagagaaaaaaaaattagctgaaaaatatggggtgcaacctaatttgatcaaatgtattagagctttcttttttcttttgtttcattttcacagtatattacatttcatatgattgaatactgtaaattttctcagttttctgataaagttatgtctgtgatacaggaactagaaagaaattattcaggcagatagtgagggtgagagtcctcggtaaggttttgttttaataaaaagcagctccgcaaatcatttccttgctaacaaaaagcagcctgaaaaatcaagcttcaaacatagagaaacaagctaaaagcttgcataggtagggaaaagaaagagagatcagactgttactgtgtctatgtagaaagggaagacataagagactccattttgaaaaagacctgtactttaaacaattgctttgctgagatgttgttaatttgtagctttgccccagccactttgccccagccactttgacccaacctggagctcacaaaaacatgtgttgtatgaaatcaaggtttaagggatctaggactgtgcaggacatgcctttttaacaaaatgtttacaggcagtatacttggtaaaagtcatcaccattctctagtctcaataaaccaggggcacaatgcactgcggaaagccgcagggacctctgcccttgaaagctgggtactgtccaaggtttctctccatgtgatagtctgaaatatggcctcatgggatgagaaagacctggctgtcccccagcctgacacccgtaaagggtctgtgctgaggtggagtagtagaagaggaaagcctcttgcagtcgagatagaggaaggccactatctcccgcctgcccctgggaactgaatgtctcagtataaaatccgattgtacatttcttcaattctgagatgagagaaaaaaaccaccctatggtgggaggtgagacatgtttgcagcaatgctgccttgttattttttactccactgagatgtttgggtggagagaaacataaatctggcttacgtgcacgtccagtcatagtaccttcccttgaacttaattatgacatagattctattgctcacatgtttgttgctgaccttctccttattatcaccctgctctcctactacattccttcctgctgaaataatgaagataataatcaataaaaactgagggaactcagagaccggtgctggtgcagatccttggtatgctgagtgctggtccactgggcctactgttgtttctctatattttgtctctgtgtctcatttctctttctcagtctctcatcccacctgactagaaatacccacaggtgtggagggtcaggccaccccttcacttgctaacaaaaagcagcctgaaaaatcaagcttcaaacatagataaacaagctaaaagcttgcataagtaaatgctggcaactgtgccaataattcctcaaggatctagaactagaaataccatttgacacagcaatcccattactggatatatacccaaaggattctaaatcattctactataaagacacatgcacacatatgtttattgcagcactattcacaatagcaaagacttggagccaacccaaatgtccatcaatgatagactggataaagaaaacgtggcacatatacaccatggaatactatgcatccataaaaaagatgagttcatgtcctttgcagggacatggatgaagctggaaaccatcattttcagcaaactaacacaagaacagaaaaccaaacaccaattgttctcactcataagtgggagttgaacaatgagatcacatagacacagggaggggaacatcacacactggggcccgttgaggtgtgggggactaggggagggatagcatcaggagaaatatctaatggaggtgatgggttgatggttgcagcaaaccactgtggcacatgtatgcctatgtaacaaaactgcatattctgcacatgtaccccagaacttaaagtataattaaaaaaaaaaaaaagaaagaaaagggatgggataccttgaagccaggtatattcaacagggaggttccctctttcctttcctttgtcaaccacacgtgcaataaagaagcaggcaacatggcactggccaggtagagaaagcatatgcataatagaagattagggtggggcagcaagcttcttcttacactatgtaaatggcacccctggttccaccaatcctttgggccctatataaatcagacactgcttcctcaagcttgtctataaaacccagtgcatttcgccatggaactagaagatctatttgggatcacctttctgcaggaaagagagctattctcttttctctttctttcccctattaaacctccattcttaaactcacttctcgtgtgtccgtgttttcagtttccctggagtgagatgatgagtcttgggtatttaccccagacaatgatgctgcttaacctgttacttttatttattcttacttgaaaaatttttatttattttttatttattttacttaaattctgtgatacatgtacagaacgtgcaggtttgttacctaggtacacatgtgccattgtggtttgctgcacccatcgacccatcatctaggttttaagccctgcgtgcattaggtatttgttctaatgctctctgtctccttgtcccagaccccctgacaggctccagtgtgtgatgttcccctctgtgtctatgtgttctcattgttcaactcccatttataagtgagaacatgcagcatttggttttctgttcctttgttagtttgctgagaatgatggtttctatccacatccctgcaaaggacatgaactcatgcttttttatggctgcatagtattccatggtgtatatgtacacattttctttattcggtctatcattgataggcatttgggttgtttccaagtctttgctattgtaaatagtggtgcaataaacatacgtgtgcatgtctctttatagtagaatgatttgtaatcctttgggtatatacccagtaatgggattgctgggtgaaatcgtatttctgcttctagatccttgagcaattgccacaatgtcttccacaatggttgaactaatttgcactgccatcaacagtgtaaaagtgttcctatttctccaaatcctctccagcatctgttgtttcttgactttttaatgattgtcattctaattggcatgagaaggtatcttattgtggatttaatttgtatttctctaatgaccagtgatgatgagctttttttcatatgtttgttggccatgtaaatgtcttcttttgagaagtgtctgtttatagcctttgtgatggtgttgtttgtttttgtcttgtaaatttgtttaagttccttgtagactctagatattagaccgttgtcagagggatagattgcaaaaatgtttgccgattctgtaggttgcctgttccctctgatgatagtttattttgctgtgcagaagctctttagtttaattagatctcatttgtcaattttggcttttgctgcaattgcttttggtgttttagtcatgaagtctttgcccatgcctatgtcttgaatggtattgcctaggttttcttctagtgttcttatggttttgggttttacatttaagtctttaatccatcttgagttaatttttatataaggtgtaagaaaggggaccagtttttgttttctgcatatggatagcaagttttcccagtaccatttattaaatagggaatccttttcccattgcttgtttttgtcaggtttgtcaaagatcagatggttgtagatgtatggtgtatggtgttatttctgaagcctctgttctgttccattggtctatatatctgtcttggtaccagtaccatgctgttttggttactgtagctttgtagtatagtttgaagtcaggtagagtgatgcctccagtttttttttttttttttttgcttagggttgttttggctatacaagctcttttttgttccatataaaatgcaaagtagttttttctagttctgagaagaaagtcaatggtagcttgatttgaatagcattgaatctataaattactctaagcactgtggccattttcatgatattgattcttcctagccgtgagtatggaatgctttttcatttgtttgtgtcctctcttatttccttgagcagtggtttgtagttctccttgaagaaatccttcatgactgtttttaggagtattcctaggtattttattctctttgtagtgcttgtgaatgggagttcactcatgatttgactgtcagtttgtctattatcagtgtataagaatgcttgtgatttttgcccattgattttgtattcagagactttgctgaagttgcttatcagcttaaggagtttttgggctgagatgatggggttttccaaatatagaatcatgtcatctgcaaacagagacaacttgacgtcctctttttctatttcaatacactttatttctttctcttgcctgattgccctgggcagaacttccaatactatgttgaaaaggagtagtgagagagggcatccttgtcttgtgccagttttcaaagggagtgcttccagctttttcccattcagtatgatatgggctatggatttgtcataagttgcttttattattttgacatatgttccatcaatacctagtgaattgaaagtttttagcatgaaggcatgttgaattttatcaaaggccttttctgcatctattgagataatcatgtggtatttgtaattcgttctgtttatgtgatggattatgttcattgagttctgtatgttgaaccagccttgcatcctggggatgaagctggcctgattgtggtggataagctttttgatgtgtggttagattcagtttgccagtattttattgaatatttttgcatcgatgtccatcagggatattggcctgaaattttcttttttgttgtgtctctgccagtctttggtatcagcatgatgctggcctcataaagtgagttagggagaattccctctctttctgttgtttggaatagtttcacaaggaatggtaccagctcctctttgtacctctggtagaatttggctgcaaatctgtctggtcctgggcttgttttagttggtaggctattaattactgcctcaatttcagaacttgttattgttctattcagggatttgacttcttcctggtttagactggtgaggctgtatgtatccaggaatttatccacttctaggttttctagtttatttgtgttgagatgtttttatagtattttctgatggtagtttgtatttctgtgagatcagtggtgatatcctatttaacttttttcattgagtctatttgattattctctcttttcctttttattagcttggctagtggtctattttgttaaccttttctaaaaaccagctcctgcattcattgactttttttgaagggtgttttatgtctccatctctttcagttcagctctgatcttagttatttcttgtcttctgctagcttttgaatgtgtttgctcttgcttctccagttcttttaattgggatattagggtgtcaattttggatctttcctgctttctcttgtgggcatttagtgctataaatttccctctaaacactgctttagctgtgtctcagagatcctagtatgttgtctctttgttctcattggtttcaacaaactttgttatttctgccttaattttgttatttaacccagtagtcattcaggagcaggttattcagtttccatgtagttgaatggttttgagtgaatttcttaatcctgagttctaattgtattgcactgtggtctgagagactgtttgttatgatttccgttcttttgcgtttgctgaggagtgttttactcccagttatgtggttgattttagagtaagtgctatgtgctgtgagaagaatgtatatctgttgatttgggttggagagttctgtagatgtctattaggtctacttggtctagagatgagttcaaatcctgaataggcttgttaaatttctgtctcattgatctgtctaatactgatagtggaaagttaaagtctcccactattattatgtgggacctaagtctctttataggtctctaagaacttcttttatgaatctgggtgctcctgtattgggtgcatatatattagaatagttagctcttcttgtttcattggtccgtttaccattatgtagtggccttctttgtctcttttgatctttgttgttttaaagtctgttttatcagagactaggattgcaacccctgctgctttttgctttccatttgcttggcaaattttcctccatccctttatttgttttgagcctacgtgtgtctttgcatgtgacatgggtctccttaatataggacactgatggatcctgactctttatccaattttcccatctgtgtcttttaattggggcatttagcccatttacatttaaggttaatattgttatgtgtgaatttgatcctgtcatcatgatgctagctgtttatttttcacattagtttatgcagtttcttcatagagtcattagtctttatattttggtgtgtttttgcagtggctggtactgatttttcctttccatatttaagtcttccttcaggagctctggtaaggcaggcctggtggtgacaaaatcctcagcatttgcttgtctgtaaagattttatttctccttcacttatgaagcttagtttggctggatatgaaattccaggttaaaaattcttttctttaagaatgttgaatattggcccccactctcttctggtttgtagggtttctgccgagagatccactgttagtctgatgggcttccctttgtagataacctgtccgttctctctggctgccctacacattttttccttagtttcaaccttggagaatctgatgattatgtgtcttggggttcctcttctcgaggagtatgttagcgttgttttctatatttcctggatttgaatgttggcctgtcttgctaggttggggaagttctcctggataatatcctgaagagtgttttccaacttggttccattttccccatcacttttgggtaaaccaatcactgcttatttcattaagttgaccttcagtctctgatatcctttcttctgcttcatcaattcagctattgatacttctgtatgcttcacgaagttcttgtgctgtgtttttttttttttttttatatctccatcaggtcattaatgttcttctctaaactggttattctagttagcagctcctgtaaccttttatcaaggttcttagcttccatgcattgggttagaatatgagttcccctctagctgagaggagtttgttattatccatcttctgaagcctacttctgttaactcagcaaactccttctccatccagttttgtgcccttgctggagaggagttgcaatcatttggaggagaagaggcattctggtttttggatttttttttttttttttttgcatttttacgctagttttccttatcttcctagatgtatctacttttgatctttgaggctgatgaccattggatggggttttagtgtgggggtcttttatgttgatgttgatgttattactttctgtttgctagtttttcttccaacagtcagctccctcttctgcaggtctcctgcagtttggtggaggtccactccagaccctgtttgcctgggtatcaccagcagaggctgtggaacagcaaagattgctgcctgctccttcctatggaagccttgccccagaggggcactggcctgatgccagctggagctctcctgtatgaggtatctgtcaacccttgctgggagttctctcccagtcaagaggcatggggttcagggacccacttgaggaggcagtctgtcccttagcagagctcgaggactctgctgggagaatcctccttgtcaggatccactcttctgttcaaagctggcaggcaagaaggtttaaatccactgaagctttgcccacagttgctccttcccccaggtgctctgtcccagggagatgggagttttatctataagtccctgactggtgctgctgcctttctttcagagatgccctgccgagtggggaggaatttagaggcgtagtctggccacagctgctttgctgcgctgtggtgaattctgtccagtacaaatttcctggcctgcttagcactgtcaggggaaaactgcttactgaaacctcagtaatggcccctccccccagtaagctcggttgtcccaggttgacttcagattgctgtgctggcagcgaaaatttcaatctagtggttcctagcttgctgggcttcatgggagtgggacccactaagcgagaccacttggctccctggcttcagtcccctttgtaggggagtgaatggttctgtctcacttgggctccaggcacaaaacaaacaaacaaaacaacaacaacagcaacaaaaaactcctgtagctagcttggtgtctgcccaaacagctccccagtttggcgcttgcaacccagtgctctggcgatgtcagcacagaagggagtatcctgctccgtggattgcaaaaaccatggggaaagcataatatctgggctggatagcatagtccctcatggcttcccttggctgtgggaggaagatccctggcaatgcagaaacaccctgccttctgcattggtctcactgagagctgcagacaggagctgttcctattcaaccatcttgccagatctccatcttctcaaagttttactgtttctagtcttatgttgccatctttcatccattttgagttgatttttgtatatgataaaaaataagggttcacttttttcttttggttgtggacatccaattttctcagcaccattttttgaagaaactcatctttcttcattgagtatatttgggactcttattgaagatcagttagctgtatatattcatggatttatttctaggctttctagtttgttatgtagatctgtatctgttaatgtggtataatatacgtgttaatttttgtatgtgaaactatctttcattctaggaataaacttgccatgtcttctaggaaagaagtgatgctgagtctgaatacacagtaaaagccaagcaacactactggtcttgcaatctcaaaaggaagagtgagactttttacataatttaattattgaagatttcattggcaaaattaaaaacaaaaattctgctcaaaatgaagccaaaatattctgagtatttgcaaaacaatgttgatactatgagtggagttgttaatgttttgtgttcaaatacaatgtgtgaaacataaggaagctcagtaacttttgtgtggggtaacttttggattagaataataaatttcaatataagcccataaggttttatattattatttttcatagcttaaaaatcattgacatagaataattccaactaaagtacatattaaattcctggaaaataaattttgacttaacagggtaagttgtgaaaagacgttttgtcgcaggaaaaaggaaatcctccatttaaaaccctccatgctggaataaaggaggagtcccatcttttggtcattccacttcaggcttttgatataactaatcccttttcttcttctttcctgttttggcaagctttcggaaacaaaacaggcaacattttgtgatcataaatatcatagttgccacgcaggccagcaggaatgctatcacatccaaagagtggtactggatccaggtgaggttgtgggctgcgacccgaaggtgcttggctcctttatggcgcatgacaaactcaatccagaagactgctcgatccaggggcttcaccggttgatcatgatgaattcttgataatttcatgatattctctttatagctgaaggataaatataaagatatcaacattaaaagtaaatttattgcttaagcatatcaagtctatggatggtctttgaaaagcgccacacaagtgattcaaagtaagtgtcattgaattgacataaaatattaatgttttaatgtatgtcattacagaaagtttggtttttaaattggagttttatcactgacaaatacctttaaaaatgaaaaatggaattttcggtgggaaagttaatgtttttctagagcagaaaatattgtgagccattctaagtgctataagtaagatagtggaaatagaatctgggaatgatcattttgatatttttagttttttttttttttgagacaggcttttgctccattacacaggctgagtgcagtcacatgatcatggctcagtgcagcctttccgtttcggtctcaggtaatcctccacctcagcctcatgagaagctggggctacagctgcgcaccaccatgcctggctatattttttattttttacatttttagatatgaggtcttgctgtagtgcccatactcatctggaactcctgtggtctaatcattctgcctctgtctcccaaagtgttggccctacagacatgaaccactgtgcccagcccattttgacatatttaaagaagaattgtgtcacaactggtgaaatgtctcctaactagtttctcagcttctactctaatcttctgtcttctaccgtattttcctactagtagccagaacattttctaaattaatgtcaaattatgacagttgcctgtcaagatttccatctggtttcttgttacattaagaataaaatccaaatctgtctgtggtctagagaacgctacacagacacctacttgtcctaaccctttccccctgtacactttcttctagagacaatggccttctgttgttctttaaactcctgaaggtgttctcaccttagcccgtttacaccttttgttccccgtgtctctctcattgagcattctttcttgcaactacttgaggtttgcttctatttctttttgaggcttccccttaaatgatacctcttagagagtgttttcctggccacactataggcacccataggatttctctactgcttcgttcttattttgctatttgatttctggaactttaaaatatgttatatatcttccacaataaaagtttaagtatgaaatacataggataaatgtatatacgctatgtgactatctcaaaattttaagattatcttaaacattatccaaaagtgaaaacaccaatttatcacaaactgcatagaagaactctttcctcctgggccattttagtcactacttttatcctcaaagtaagtattaacctgaattctaatatcatagattatgtttatataattgaattaaataatacttattcatttctgtttttgtttagcagttgtttaattgcactggtgtagagtattcagttgattgacaaagaccacagatctcttcatttatgattaatggatatttgtgttgttaacattttttgatcttactaataattatggtattaagatatttatatattttattagatttacatacttattcatttttgttggatgtatacttggaagaatagttgatgagagaaaggcatatttataattagaattttttgactgaattttttaaaaaatattttttattttaaagaatcagagattgtttttagttatcattttctggatgatttataatttgattctagtatgactagaacatactatttttatgaatttgaatcttatacaatttacttagcatttttttatggcccagcatatggtcaattccagtaactatttcatacatataatctttttttttttttttttttgagacagagtctctctctgtcacccaggcttgagtatgacggagcgatcttggctgactgcaacttacgtctcctgggttcaagtgattctcatgcctcaacctcccaagtgtctgggactacaggtgctcatcccccacatctggctaagttttgtattactagtggacacaggatttcaccatgttggccaggctggtctcgaactcctgaccaaatgtgatcctcccaccttggcctcccaaagtgttggaattacaggtgtgagccaccacacccagtctccataaactcttttaaaaatgtttattttctgtctacacacacacaaccagagatatatgtatggatacatatatacagatatatgtgcaatatatatacacacacacacatataacacataggttacatttaattgtgtacttcaaatgttttatctccttaaataaaagttttcaaagatcattattttgtctactttggtctgtttaaatttaatgcgagtactggtaggttcacttttttgttgtgatctttgagatggagtctcgctctgtcaccaggctggagtgcagtggcactatctcagctcactgaaacctccgtctcccaggttcaagtgattctcctgcctcaaactcctgaggagctgggactacaggtgcacaccaccatgcctagctaatttttgtatttttagtagagacagggtttcactatgttggccaggagtatggtctcgatctcttgacctcgtgatctgccctcctcagccacccaaagtgctgggattacaggcttgagccaccacatctggtcggttcacattttttaaaaacagttttattttaagttccaggatacatacgcagaatgtgtgggtttgttacataggtatatgtgtgccatggtggtttgcagcacctatcaatctgtcatctagattttaagtccctcatgtattagctatttgtcctgatactctcactcccattccatgccccgaatggccccggtgtgttttgctcccctccctgagtccatgtattctcatttttcgactccctcttatgagtgagaacatgtggtgtttggttttctgttcctgtgttagtttgctgaggataatggctttgagtttcatccatgtccctgcaacagacataatctcattcctttttatggcacatagtatgccgccatactgtacatgcatcatattttctttatccagtctatcattgatgagtatttgtgttggttccatatctttgatattgtagatagtgctgcaatagacatacatgtgcatgtgtctttacagtagaatgatttatatgcctttgggtatatatcaagtaatgagattgctaggtcaaatggtgtttctggttctagatctttgaggaatcaccacattgttttccatgatggttgaactaacttacattcccaccaaaaatgtaaaagttttcctatatctccccagtttcaccagcatctgttgttttttgactttttaatcatctccattctgactggcatgagattgtatctcattgtggttttgatttgcatttctctaatgatcagtgatattgagcttttctcataagtgtgttggctgcataaatgtatttttttgagaagtgtctgtttatatcctttgcccactttttggtggtggtgttttttttcttgtaaatttgtttaagttacttgtagattctggatattggacctttgtcagagggatagattgcaaaaatgttccctcattctgtaggttgcctgtgccctctgatgatggtttattttgctgtgcagaagctctttagtttaatttgatcccatttgtcaactttggcttttattgtaattgcttttggtgtttgtgtcatgaaatttttgcccacgcctatgtcctgaatgatgttgcttaggttttcttccagggtttttatggttttgggttttacatttaagtctttaatccatcttgagttaatttttgtataaggtgtaaggcaggggtatagtttctgttttttgcatatggccagccagtttccccagcaccatttattaaatagggaatcctttcccattgcttgtttttgtcagttttgtcgaagatcagatggctgtagatgtgtggtgttatttctgaggcctctgttctgttccattggtctatatgtctgcttttgttccagtactatgctggtttggttactgtaaggtgtaaggaagggatccagttgcagttttctccatatggctaaccagtttttccaaaacaccatttattaaatagggaatccttcccctaattgcttgtttttgtcaggtttgtcaaagatcagatggttgtagatgtgtaatgttatttctgaggcgtatgttctgttccattggtcaatacatctttttggtaccagtaccattctgttttggttatgtagcctaatagtatagtttgacatcaggtagcgtgatgcctccagctttgttctttttgcttagggttgtcttggctatatgggctcttttttggttccatattaaatttaaagtagtttttttctagctctgtgaggaatgtcaatggtagtttgatgggaatagctttgaatatataaattactgtgggaagaagccaagatggccgaataagaacagctccagtctacagctcccagtgtgaatgacacagatgaggaatgatttctgcatttccaactgaggtactgggttcatctcccaggggactgtcagacagtgggtgcaggacagtgggtgcagcgcaccacgtgtgagccaaagcatggcgaggcattgcctcatcagggaagcacaaggggtctgtgaattcccttccctagccaaggataggggtaacagatggcacctggaaaattgggttactcccaccctaatactgcgcttttccaaaaggttttagcaaacggcacaccaggagattatatcgcgcacctggctcagagggtcctacgcccacggagcctcgctcattgctagcacagcagtctgagatcgaactgcaaggcagcagtgagactgggggaggggcgcctgccattcccatggattgaataggtaaacaaagcggcccagaagcttgaactgggtggagcccaccgcagctcaaggacgcctgcctgcctctgtagatccacctctgggggcagggcataaccaaacaaaaggcagcagaaacctctgcagtcttaaatgtccctgtctgacagctttgaaaagagtagtggttctcccagcacgcagcttgagatctgagaatggacagactgctactcaagtgggtcctgatccccgagtagcctgactgggaggcaccccccagtaggggcagactgacacctcacacagccgggtactcctctgagaaaacttccagaggaacaatcagacagcaacatttgctgttcactaatatccactgttctgcagtgtccgctgctgatacccaggcaaacaggatctgcagtggacctccagcaaactcgaacagacctgcagctgagggtcctgactgttagaaggaaaactaacaaacggaaaggacatccacaccaaaacccatttctacatcgccatcatcaaaaaccaaaggtagataaaaccacaaagatgggggaaaaaagagcagaaaaactggaaattataaaatcagaatgcctctcctcctccaaagaaatgcagctcctcaccagcaatggaacaaagctggatggagaatgactttgacgagttcagagaagaaggcttcagacgatcaaactactccggactaaaggaggaagttcgaaccgaaggcaaagaaggtaaaaaccttgaaaaaagattagatgaatggctaactagataaccaatgcagagaagtccttaaaggacctgatggagctgaaaaccatggcacgagaactatgtgatgaatgcacaagcctcagtagctgatttgatcaactggaagaaacggtatcagtgatggaagatgaaatgaatgaaatgaagcaagaagagaagtttagacaaaaaagaataaaaagaaatgaacaaagcctccaagaaatatgggactatgtgaaaagaccaaatctacatctgattggtgtacctgaaagtgacggggagaatggaaacaagttggaaaacactctgcaggttatcatccaggagagcttccccaatctagcaaggcaggctgacattcaaattcaagacatacagagaatgccataaagatactcctcaagaagagcaactccaagacacataattgttagattcaccaaagttgaaatgaaggaaaaaatgttaagtgcagcaagagagaaaggtcaggttacccacaaagggaagcccatcagactaacagctgatctcttggcagaaactctacaagccagaagagagtgggggccaatattcaacattcttaaagaaaagaatcttcaacccagaatttcatatccagccaaactaagcttcataagtgaaggagaaataaaataaaatctctaagcatttacagacaagcaaatgctgagagattttgtcaccaccaggcctgccctaaaagagctcctgaaggaagcactaaacatggaaaggaacaactggtaccagccactgcaaaaacatgccaaatgataaagaccactgaggctaggaaaaaacggcatcaactatcgagcaaaacaatcagctaacatcataatgacaggatcaaatttacacataacaatattaaccttaaatgtaaatgggttaaatgctagaattaaaagacacagactggcaaactggatcaagagtcaagacccatcactgtgctgtattcaggaaacccatctcatgtgcagagacacacataggctcaaaataaagggatggaggaagatctaccaagcaaatggaaagcaaaaaaaggcagggattacaatcctagtctctgataaaacagactttaaaccagcaaagatcaaaagagacaaggccattacataatggtaaagggatcaattcaacaagaagagctaactatcctaaatatacatgcacccagattcataaagcaagtccttagatacctacaaagagacttagactcccacacaataataatgggacactttaacaaaccaccgtcaacattagacagatcaacgagaaaaagttaacaaggatatccaagaattgaactcagctctgcacgaagaggacctaatagacatctacagaactctgcaccccaaatcaacagaatgtacattcttttcagcaccacaccacaccaactccaaaactgaccacatagttggaagtaaagcactcctcagcaaatgtaaaagaacagaaattataacaaactatctctcagaccacagtgcaatcaaactagaactcaggattaagaaactcactcaaaactgttcaactacatggaaactgaacaacctgcttctgaatgactactgggtacataatgaaatgaaggcagaattaaagatgttctttgaaaccaacgagaacaaagacacaacataccagaatctctgggacgcattcaaagcagtgtgtagatggaaatttatagcactaaatgcccacaagagaaagcaggaaacatctaaaattgacaccctaacgtcacaattaaaagaactagagaagcaagagcaaacacattcaaaagctagcagaaggcaagaaataactaaaatcagagcagaactgaaggaaatagagacacaaaaaactcttcaaaaaatcaatgaatccaagagctggttttttgaaaaggccaacaaaattgatagactgctagcaagactaataaagaagaaaagagagacgaatcaaatagatggaataaaaatgattaagggggtatcaccaccgattccagagaaatacaaactaccatcagagaatactataaacacctctacgcaaataaactagaaaatcaagaagaaatggataaattcctcgacacacacaccctcccaagactaaaccaggaagaagttgaatctctgaatagactaataacaggctctgaaattgaggcaataattaatagcttaccaaccaaaaaaagtccaggaccagatggattcacagctgaattctaccagaggtacaaggaggagctggtacccttccttctgaaactattccaatcaacagaaaaagagggaatcctccctaactcattttatgaggccaacatcatcctgataccaaagcctggcagggacacaagaaaaaaaagagaattgtagaccaatatccctgatgaacatcgatgcaaaaatcctcaataaaatactggcaaactgaatccagcagcacatcaaaaagcttatccaccttgaccaagtgggcttcatccctgggatgcaaggctagttcaacgtacacaaatcaatgaatgtaatccagcacataaacagaaccaatgacaaaaaccacatgattatctcaatagatgcagaaaagacctttgacaaaattcaacaacacttcatgctaaaaactctcaataaattaggtattgatggggagtatctccaaataataagagttatctatgacaaacccacagcaaatatcatgttgaatgggcaaaaggtggaagcattccctttgaagactggtacaagacagggatgccctctctcaccactcctattcaacacagtgttggatgttctggccaggagaataaggcaggataaggaaatacagggtattcaattaggaaaagaggaagtcaaattgtccctgtttgcagaagacatgattgtatatctagaaaacctgatcgtctgagccccaaatctccttaagctgataagcaacttcagcaaagtctcaggataaaaaatcaatgtgcaaaaatcacaagcattcttatacacccataacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggaaacaaaccaatggaagaacgttccatgctcatgggtaggaagaatcaatatcgtgaaaacggccatactgcccaaggtaatttatagatccaatgccatccccatcaagctaccaatgactttcttcacagaattggaaaaaactacttgaattcatatggaaccaaaaaagagcccgcatcaccaagtcaatcctaagccaaaagaacaaagctggaggcatcacactacctgacttcaaactatactacaaggctacagtaaccaaaacagcatggtactggtaccaaaacagagatatagaccaatggaacagaacagagccctcagaaataatgccacacatctacaactatctgatctttgacaaaccttacaaaaacaagaaatggggaaaggattccctatttaataaatggtgctaggaaaactggctagccatatgtagaaagctgaaactggataccttccttacaccttatacaaaaattaattgaagatggattaaagacttacatgttagacctaaaaccataaaaactctagaagaaaacctaggcaataccattcaggacataggcatgggcaaggacttcatgactaaaacaccaaaagcaatggcaacaaaagccaaaattgacaaatgggatctcattaaactaaagagcttctgcacagcaaaggaaactaccatcagattgaacaggcaacctacagaatgggagaacatttttgcaatctactcatctgacaaagggctaatatccagaatctacaatgaactcaaacaaatttacaagaaaaaaacaaacaacctcatcagcttgtgggtgaaggaaatgaacagacacttctcaaaagaagacatttaggcagccaaaagacatatgaaaaaatgctcatcatcgctggccatcagagaaatgcaaatcaaaaccacaatgagataccatctcaccccagttagaatggcaatcattaaaaagtcaggaaaccacaggtgctggagaggatatggagaaataggaacacttttacactgttggtgggactgtaaactagttcaaccattgtggaagtcagtgtggcgattcctcagggatctagaactagaaatatcatttatctagcattcccattactgggtatatacccaaagggttataaatcatgcttctataaagacatgtgcacaagtatgtttatggaggcactattcacaatagcaaagacttggaaccaacccaaatgtccaacaatgatagactggattaagaaaatgtggcacacatacactatagaatactatgcagccataaaaaatgatgagttcatgtcctttgcagggacatggatgaagctggaaaccatcattcccagcaaactatcgcaaggacaaaaaaccaaacaccgcatgttctcactcataggtgggaattgaacaatgagaacacgaggacacaggaaggggaatatcacacaccggggcctgcttgggggtagcgggagtggggagggatagcattaggagatacacttaatgttaaatgacgagttaatgggtgcagcacaccaacatggcacatgtatacatatgtagcaaagctgcaccttgtgcacagataccctaaaacttaaagtataataaaaaaaattactttgggcagcatggccatttttacaattctgatttttttatccatgaggatggaatgtttttccatttgtttgtgtcctctcttaattccttcagcagggttttctatttctccttgaagaggtccttcacgtaccttgttaggcatattcctaggtattttattctctttgttgcaattgcaaatgggaatttattcgtgatttggctctgcttgtgtattgttggtgtataggaatacttgtaatttttgcatattgatttttctatccggaggctttgctgaagttgcttatcagcttaaggaattttagaactgagatgaaggggttttctaaatatagaattatgtcatctgcaaatagagacaatttaacttcttctctttctatttatagaataccctttatttctttttcttgcctgattgccctagttcacatttaaatccaccattttattctatatatttttgttttctaacctgttttctgtttctttgcttttttactttatttgaagtattttaaatcatttcttgtcttactaattttttggtaaagtgtttttaatgtattctcttagctggtaccaccttacatcataataatattggtaggattaatagactctgaattgatggtagctggtgtagtcacagcattttccatattatttcccttggattatggaaaactattacatatttattttatcaatattaaaaccttcatgtttcaaaaggcatcctccaaaaagtaaaaaaaaaaaaaaatctatctgcccatagtggaagaaaatatatgaaaatcgtatatttgataagggatagtatctataacatattaataattcttatgaatccataataaggtaaatagaaaaatgacaaaatgttcacaagattaaaatagaaattttatctaaggaagatgcatgaatgatcagtaagcacatgaaaagagggttaacatcttcagccataaggaaatgcaaatgaaaaccataatgagagaccactttacacacactagaaaggctgtaatagaaagacaggtgataacaagtgttgggaagagtgtgaagaaattagagccctcctatccagctggtggtaatgaaaaatgatgcaaatactttgaaaaacagtttagccattcttcataaacaacaatttcccatatgcctcagcaagtccactcctagcctctcctcaaaagaagtaaaaacatatttttacacagaaaatatgtataacaatattcgtaagtgccaaaattggaaagacctaaaatgtccatgccctgataaatgggtaattttggtataaacatatcaaagaatattatatagaaataaaaatgaatgagttctgatacatccaacaacataaataaaactaaaaataattatgctaagtgaaagaagtcgtttacaaaacactataaattgtatgatttcatttatataaaatatgtgaagagaataatctattgagaaacaaagtaagtcggtatttttctaggactggaggtgtattgggagtgacttcatgcattttgagtttaatttgagctcacaaaaatgttatttagggttgtggcttcgtaactatgtaaacatactaaatatatttagattttaaattttagtgaatgttatgctatgcaaattgtaactcattttcaaattgattaaaataatgataataataaaaataaatttttgagaaagaatagattcatactttcagaaattttaggtattgaattgaaatattttatcatatttctctagttacataatttctattgtgtattctatcattaaaaatatttaaaataattatgtacatatctttaatttttttgattttataattcattgcagtcattggtgacccattaaatctgtggggttgaaatgtaactttgaaataattgtctggtggaaaataagagcagattttacattggttaaatcacttcaatcccttcaaaattagtctcttaacaaagggttcaaactcatattcactgttgacaaaataatttgtaagtaccacctggtcacaaaattgtaatactcacatagggtcattaatgactgacttcaatgcattgagcaaatctctacttgacatggtcctgatgtccacactgagggctgctcccttggctttcatgtgagcaatgttatcatgttgatccgcaaacaagggaatgcccaccatagggatcccatggtagattgcctcatagatgccattggttccaccatgagttataaaagctttggttttgggatgacctaaaagtggatgcattttaacaaagttattaattataaggcacaggaattgaataagaaatgcacaatataaggaacttaaagcaaaactgttccctaggtaacattatacccacaaaactgcattgaaattgttttcaaatttcagaggaagaagcacctacttctgctggaaaggtaagtgaaggctacatgaaaaggtggtggtctgtgtgtcttcacagtggaaacataaatttaaaagtttgccaggtgaacaaaatgaaaaaacatattcttaattaaaaaattaaaatgtgcaaaaaagaaaagaataagatttggtatacaagaacatagtctcttaagtagtataaattatgcagtcacatttatatatttaaaaaatatttaaatagttaaaatatttaaaatacttaaatttttttttaaaggcagcaaggagtagggtggaggtggtgctgaggaaggacaggttacacatcatcatgaaatgtgttatcactttatgataaagattggtgatttattcccacagaaaatagagtcactggtaatagaagaatgtctgttatttttcagtacctgttgaaataaccctgcagtaggggaaggaacagatgtaaagttgcagaaataagagacagaaaatccaggatgttatttaaaacctgtgagaggtaattacacctgaataaagagatttttattctgaccataaagaatgtgactgtatgtaacaaaatgccaactaccatagtgtattcttcttatactaagactagaaaataaatataaagtagttaaatttgatttttttttagttttccaataataaatgttaaatatgtttgttttatgttgaaatattatcacttctaattggctgttactaatatattcagtatttgttctccagagtcttaccaagaaggtcattctggggtaaccacttatacagtcgagtattggaacctaaagtatttggcttcttgccatcaaatctccatagaacctgttagggcaaggaaaatatcttgttcaatgaatagaactctaaaaatataacttgttagaattctgaagagattaataatcagttaatccatataaaagatgaagaaataagaagaagtgatgtcaagtaatgagaactactaaaagtctgaggtaagctgaatacccacatttaatatctttacttttataatcaatttggtatataaaaaaatgacatttctaacttaatagctagacacatgagagtgtgagaggaaaataaatcttggtgccccaaaatctatgctaaagggaaaagttaagctgctcagggcaaacctacttcccattctattcaaagtcagcccttggctcactgagataaatgcatatctaattgcctcatttggagaggctaatcagaaactcaaaggaattcagccatttgtctcctatctacctatgacctggaagccccttccatgcttcaagttgctctgcctttgtttctagttgtcccccatttctggactgaacaaatgtccatcttatataagttgattgatgtctcatgtatccctaaaatgtataaaaccaaactgtccccccaccaccttgggacacatgtcaccaggaccccctgaggctgtgtcatgggtgcacattttcaaccttggcaaaataaactttctaaattaactgagacctgcctcagatattcagggttcacattttggtaaccatgaagagactctgagtggaggttccctgacctttgataaatgtcctgtcagtgcttggtaccagcatgagctaactttatggctcaaacaaataagacaattggctgaggtctgggagcaacccctccagagaatccctgataccccaaaattcagtcaagaccaaaagtttattttgctgtacaactcctttttttttgttttttatttttttttggagttttacttgcttcctacaagaaaggcaatatttcctgtttccatgacaatggaaggcaggtaactctatggagtttgagctcactcccaggagggaggataaatttgaggtttctttcctacttctaggacgacagagggcagttttagcctgaaacccatccgtaggtaaatagctgaattggggttttgtcttggttaatgtttaacaactagctggacttaatttctccttaccattacagtgcttaatgatcacatttttgggagtattttttttgtacattccagtatttctcccatcagatttgacaaactttacctgacttgatcatatctgagtgagaattccaaattgtgggtaacaaagcctgtctaatttggtgaaaattcttcacagatgcaaaagagaaaacaaaacaaaacctaaaaaccatgctcttggtttctgtgtttgcttcctgtctttaaaaaaacaaatgttcttttgtttacttttcctccaccctatacctccttttgtcttttgccatttgtagtaccaaaaatctagagaaggcttctaatgatttgaactcttttaaagaattcagaacaaaggcaccactcacccctttgggggtgctctgttttctttgtggagtttcaagagttgtgggcagattttttcttaggtccaaagctctgttttcctatgttgaatgacctgatctctttggcttcgagattaccacagattaccttgtactgtgagaggattttaccttggcgtgtgtaatggcagacgagttacaaagtagagggtggctgagtacagtttactggaagtagtattgactgttgttatttttttcctcctaggaagttgttgtttaagaatcctaattctagtttggagatgtgttgtaaagggtctcctctattgtttttattccccaaattaatctcatttggcttgtctgtgtggatttgtgtgagaaactgaactgtggtttacataggaaaatgaaagactgagttttctcagctccaaagtgaaagggcatctgctcctcccaggcaaaaggcacccctaagcaactgggggccttgtgggagtgtcttgggtttgaccccctatgacatgcagtggtcctgcagggaaatccccaagaaaaattaacttttaaaaaaaggctagtccaggaaacacatatgagggcagatcacccagcattttgagccctctcagaggtcatacacctctggagggagaaactgagacacgtaagagggtggaaacaactcagtggtgacacactgtggagtactgcccacaagcagcacacattgattcaccacacataaaccctaggccacagctcagttcctccttttaggaaaaaaagtgggaaacaaataatctaagaatgatgagaaaagaagaagaatgatcccctgatatcgcctgtttggatttatgacacctctacttggcagagtttatgtaaaatgaaggtaatacggtctttgtgcacatatacattaagagccctaaggttgtcctacaaactgtagagttcctaagttctctcttttttaaaaattttcttttattcttgctttaaatttgcttttatttttctattaagttaaaaaccactgttttgattcaacaggtttttgtctgcaagctggtgatttttttttatctcatagctaaatttctgaagtaaaaaccacataatcttttgtgtgtgtgtaagtgtttgcatatatttaaaaggccattataatttctataattttatgtttaattggcaattaaatccattttattttccttctagcacaccaatttttttctctgtgtacattatgatgtaaattttgctatttgattttcacctgaatggtttcttttaatatgcaaatgtaagattatttagctcacaactgcctatggtgatcaagtattcatacagattacctattgaaacaggttatcaagaatttgaaagtctaatatggcaaagaggagtttttataaacctgtaagatgtacttctgttggcatgcttactacatctatgtatttatgtgttttgtacacaatgttttattactgaaaatatataaaagagctctaattaattggcttaagaaaataaaagtgcttgaattaaatactttgccagaaaaaaagactaattaaatgctttttcaagtttatgtaacttaaataaaatcttttataaataagataacaacaattattgataaagtatgataatattagaaatgcattaagacttgccagcatacatttttgtttgcatttattaatcaagaaatttcatacttattcttgccaaatactttaaggtgtcaaaatttgacataggggttacaaaactgtaaaccaagcccaaaacagaatgatcttcacttgtgtaatttttaataaataagacattaatattggtttaatgcaaatagctacaccttgaattaagtaagattatcataacttctcatcttgtggccttaagcaatctagtccacaggcattaagctttgttttgggaaaagactgttatcatttttatttcaaagctaaactataaactaagttcctccttaagttagtttggcctacacccagaaataaacacggagagcttggaggttaaaagcaagatggagttaggtcagatctttttcactgtctcagttataattttgcaatggcaattccataactttaaatgatgactaccacacttttcacaaatattctaggtaaatgactaaataattaggtaaatgtaatgggataaatacttatagacaaactcataatttagaatctaaggttatattaaattaaataatagatatttcattgtttgggtatttttaaaaaaaaatttgtaggaaaacattctttccaaaaaaaagtgcatcttttttaaaaaggtgaagaagtgttgtctaattcaaagcttatttaaaggttatgtataaaacaaggtaaaaggaaccaggaagtaagggagatgtaaagaaagttataaaaataaaaagttttttttttttttttttgtaaaaagcttgaagagaaataattttatatgagaaagaatcttgtgtggtaaatttagtcctagaataaaatgatcagttgtgtaagaaagaaggatgttcaggacaaaccagaaagtccaaacatatcatgaatgatctgtgtaagtcacaataagaagattaaaaaaacttttatatgatcaagttgtctataattaaagggaaattataatggtgtttctacagattgggcttgatgtaaaaaaagcacttatgcactaaataattggttagaacaataacattttcttaagggattgatttactcttaaaatattatgagttttttttttttaacccaaagtttaacttttcttgcatctcactgtttttggttttctctccccttttaaagggtgtgaaatagtaacactctccttcaactcattttcaactcatgtaagttttttcctcaagttctgtttgttgtggcataatgctaacagtgttttctaaaagctattcaactcctcaaggtccagggactatcacagaagaggtgggtgtgtgagattgaaagaactgatactaagagataaaataagttccgtttatgcataaattaatcattaatgtcaaagacacactaatgcaagaccaacatatgggcccctgtgtcagattaacaaggttttcttgaagcataaactgacttcttaataaagattataaacgttatgaaaggctgaggaaagttatatcttatggtcaagattagaattttatagattgttcatacaattttgaaaaacaaacttatttggcttcatgctgttttattagggcttattgtttggcaaattgagtctcctctctcaaagaatgaagatttttgcctttttttgaaatccttgagttactactttagtcaaatgaatgctttattttacctgtgatatcaagctttttaatcctttgatatttgacaaattttccaaaattatgtttttttctgacctaagtaatcctttaatttattagtttccctaaagtccaaaaatgacataatttggcttatttggtataaaaattatacagggaacattgtcaaacatgaaatggtgtttggtctttttgagctgtatttatataaatatgttattggcatgtgttccaaaattatgggaaactcctataattctgatatgacttagtgtgtacattatcagtaataattatatttgttatgttaagttattgtgtgccacagaggtaacaaatttccttgtccattgtgtctttgactgaggctgccctaaaactttttgtcatccacagacaattgttgtctgactttggtcctctttagaaggcgattttatactcagccatgaaattctaacaggtgctcttgaaaaaaagtttttgataattttggagattgtgacattagaatggaagaaaaactttcaggactcatggagaactaaaatgttcatgaatatcaagcagaacaggaattaactacatggactgaaataatagaaaactaaagtaatctttttgactttgcttaaaacattgctgatcctttgttttgttttgtttttttttttagagtgaaggaatctttctttttttgagctattaacagcttttaacaatttagtatactcctatgaaaaaaatttagaacatatttgtttccctctacctgatttttcagaatttggaaactatttgtgagtattttttacttttgtcaatacagttatttgcataagtgcaataagaatctattttcatttttaacaaaacacaattggagaaactggttattttatcaaggcttccactggaatggtgggctttcctttagggaatcaaacttaacttatggagccaataaaaccccttgggaaaactggcctcataccttcatctataaggtccctgtacagggttcctgaactgtgttaagcaaagaatgtaactttctgacaggcccaggagccccaagtttattttggaaccccaagaggagaggaattcacccaactcataggtatttgatggtacaaatctatggcttgcctcagctttaaaaaagtcctatctgagattctttctataagacaaagttccatcaaagccactttaaaagcctatgtaaataaaaaattattcttcctcctctgtatacaataatcaggccaagtataataaagcaaatcagttgtaccatggtttgtctttagtaaaattgggaaactgaagacagaaaaattatgtttcaaaaataacagtatacctgttgttagattctagtcttgcctaatgtttttcaatttttattactgtctacagtttggactgaattctaatttttcatggctacacgtcttcaaaatagtgtcttcaggttttttttcctccccttccacaatttttcctaatttggagtcactgtaaactaagctatgctttcataaagccctacaaattaagctagacaacttaaactccagaagaaaataacagcaaccaatttacatacataatccactttcatacctgcctactgatttatggacttcagagtaatgtggcctatattaattttaaaggattgttcttttgtttttgtttttctcacttcctccctttattttgtcttcacagtacatgagacttcagaacctgctaaaaatgaactttcctaataactcaggacctgcttaggaataaaccttccttgccattagagatcagatgaaaacctgagaccagagactcattttcttctaaaatgctttctccaaaagatttttttaaaatgtaaaatgaaaataaacctgggggccccaaagtcactaagcaaatcactgcctcccattctattcaaagacacccctctgctcactgagataaatgcatatctgattgcctcctttggagagcctaatcagaagctcaaaggaatgcctcttccctgcttcaagttggcaaaataaactttctaaatgtactgagacctgtatcagatatttggggttcacaagattatcaatgaaatattcaaatatataagaattgttaggcagtcttaattctagtaataaaaaagtagcaaattagtaataacctatatatttattttatatactttatactagctgtaaccttccaaatttaatataaatttattaatttttgagtgatatgggaagagtttacttatatccacttgtctactagtcataagttattttatgaatttgacatcattgattacaaaagactaaatacttaaactgcacatatggtgagaaataatgctacatatgtagtaaattcagactattatcagtattgctacttttgtaaatgctaacaatgtaggaaaaaggagcccattgacaattcatgattaacaatacagatgctgagaatgtagaaaattgtattttgctactttttgcttaactgatctttcacacttagatgatgcactacctagcattgacagccttgatatatggtcagctatagccagtcattaccatgtctagtaccaaactaaggtactgattttagatttcccaagcaatctttataaactggagtagaatttacaagtgttgtccttgtatttgatatgggagtgttaaagtaactctgtgttttcagcaaaaacttgcatagatcattcagagagggctatgcagataagaaagtaaaacgtaaattgaaaatacacaaagattgtaggtatattctatagattagaaaataagttcctaccatgtttatttatagttcctgctccttcctcaatgtggagaaggcactaatctgattcttagagcatagtctttgttgggccacatttaataatgcacatagtctaccctaaaagcaggattctatctccatcctttccattacatttttctgcttaagacattagcggcacccaagccagcagagcagacaagtttttctttttctctaaatctacttggctaggtgggtacctccagagcagtggctagtcagactaggacattctttctctgaatggcaccctgaacagaacgctaaatagacctattccaatgcatgggaagtaaaaacagccagattgcttggtaagacgaagctgcatgatgcatttcaaagttttttcaatacctgcttattgttattgtgatagtacagtaacttattaaaattttaccgctttttgataatatctacagtgtatacagtaccttctaaaatcctgtaaaccaaaaggagcaaatgacagggcagaatttagtgatttctatgtacatgctacgataccatgataataccaaacttcactagcacctcttaaatatatttccttctgatcacaatattaatgccaacgttattatcaaccaaaactcctctctttatgattttaagatcttccatatatgtttttgctttgaacagatgtctgagataattagaactatcatagcagttaaattttcaggcagaacatttctgtaatggactcttgaagagtttaacagattcatttagtagccatccacagttaaggcactttatctaaccttttgtgggatctgggcaagggctgatgcaatcatgttggcactttcttctgacatgttactgatcatcgaccccagagaaaacaccacaataccattttctccagagctctgcacaaactcttccatttcctgtgaagaaagaatttgttctatcagaaaagagcaacagcacagaaaacactgttgacaggattgttacaaacatctaagatgagaaagtcaggagctattggagtaatttttttaaactgacctaatcattcagtttctttgaaaggagatgtgtaatataatatatgtgggatctttcatgcaaatttgtgtaaatatgtgtgcatatgcatgtatgtatgtgtgtgtaaggaagaaatgaaacaaagctatgacactgcagtaggaggagataatgctagaaaatattacacccagacactttatttataatattataattactaacataggttattggaaggtagctttacttggctttaattctatttttttttgtagttctactaaatctcttgtgtttatttggggtcattttattttatttttttctgttcagttcttttagttaggagtcattggagccattacatgactatgagcaatgaggaaaagttagttacaattagaatgattttatatctacatttatttagcttctttagctctctaaccctttatatttcacttagagtttcctagtcttaccccactacccctcacttcccccgacacccccacccccaaaaaacaccttaaaagctgaagtataagaatcattgacgttcatcagtctggtgttggggcttggaatttccgggaaatagttctgagaattccatttataatacagtattatatactatttagttacataattaagtgatcttatttctcagatcattgtttaggtatgactatgataccttttgtcctgaaatcacactgtgaaattgatgtgctatttataacttaccatgagggaccctcatcctcactttgctgtgtctcacagggggcacttgaaccacagtgggagaggtcaccaagcctttctccagtggagatctgctcaccccctagagtagctccctcacactatatgaagctcctggtaaatatgtgtttgcttcgaaatgaatgagaattattctgacttgtgtttcctgatgtgttcctgtttttaaacttaaatccattctctaatgccacatcagtcaatgtattctcacaccaaaaaaaaaaaaaaagaaaaagaaagagagaaagaggaaaagaaatgtagactcataagtttcccggatatcatatcaaaattgtatactcatctttttgttgctattgtcccttttgttctaaattctttttttctcagtaaaataatgaccaaccccttctatcataacaaatatactttctggtcctaatcattgggggaaatttctttataaaactgtttacgaataaaaaaggaaattctaaaatatgtcaattcagaccatatattggtatttttcaaaaatataattgaactttatgacatcttttatttttattttattttatttatttatttatttttgagatggagtcttgctctgtcacctaggctggagtgcaatgatgcaatcttggctcattgcgacctctgcctcccaggttcaagcaattctcctgcctcagcctcctgagtagctgggattacaggcacctgccaccacgcctggctaatttttctgtttttagtagagacaggtttcaccatcttggccagactggtcttgacctcctgacctcatgatccacctgcctcggcctcccaaagtggtgggattacaggcttgagccactgtgcccggtctgatatcagttttaattggagattcagtgtatggctattagagttaattcatgaggcatccaggaactcagtgtaattgcagttgcctgtagccacatttaatgtaacttcggtttaatgttttgtctcattcactgacaaaagtcttcttcatccaccaagtattgaagtaaaaaatcgtctgtttatagacagatcagcactgatctcattctgtgacgtctttatgaaagcaatggtaatagaagatcaatgtaagtagtcttgtaaaagtatgaaaatttaggaaaaaaatcatttttcccatatctctatctcaatttaaaatgtgtaccatttcattatggttttaattctatttatataactcaatgtacatatgtgatgtttatttagaaaattttttctcattgtatatgcctttttatcctacaaaaaaattgtgatcttgttctactcatcattctgttccttagtttccaactatacctgtactacagctgacagtgtaattaaacattgttttgaaaaaatggattgtaatggcttggtatgcgcattgtataagtttttaaccatttcttaatgtaagatatttgaattatttccagagttttttaacgaatatttgctactaatattgaatcttaccatcatgatttattctctgtacagtttcatgtgaatatattacaaaggcaataactatatgcagttttcaaacacttgatactttttggcaagagtcttattcttttgaaatatacaaacattatctgagaatctaatacataatggaaaagcaagcaaatttgtggcaacaattattttgtgtacaaaagaattagagaatcggtttcacaattatttacttagattcaagtctaccttttgcaggttaacaacaacagccagtgccgggcacggaggctcacacttgtaatcccagcactttggaaggttgaggcaagtggatcacctgaggtcaggagttcgagaccagcctggccaacatggcgaaactctgtctctactaaaaatacaaaaattatccggatgtgttggtgggtgcctgtaatcccagctacttgggagtctgaggcaggagaatcagaatcacttgaacctagagggtggaggttgcagtgagctgagatcatggtagtattagtaataatcactattgtactactagtcatttattccttgtcctccttattctcctattctcttccccctgctaatggcactatcactttcttttgatgtgagtgaggatttttttttgagaataagataagagtacacagaattaccttttaagctaaaatattaatgaagtgcctccacctttgcaatacaactttagctttccagcgtgttcaactgactgcccaaacttaaacatttatatttaaacaagcacacagagtatctgttctctaggattttgctaggaaaatcaatcattattaaatgaagactgatatcttaaatggctggcacatgttagctaatttaaaatattagaaataatgactaaaataataatcataatatcaacaatatttttggatcactggctatgtgtcagagacaacttaagtgttttatctgtggtaactacttttttccacacaacacaatatgaagttgtgattattattgtaaaagtagtcatgattgcctaaactcatgtaaaagttcctaaatattctttacattgtacaaagttgcctttctgtaatattacacattgagaacattgggattttttttgaaaggaaatctgatcatatctcttcatttcttaactcttttcagtagctctccattgtccttaatgggtatatcaaatttcatatatatatatatatatatattttttttttttgagacagagtctcactctgttgcccaggctgttgtgcaatagcatgatctcggctctctgcaacctctgcctcccgcgttcaagcgattctcctgcctcagcttcccgagtagctgctattagaggtgcctgccaacatgcctgactaatttttgtatttttagtagagacggggtttcaccatgctggccagtctggtctcaaactcctgacctcaggcgatccgcctgcctcggcctcccaaagtgctgggattacaggtgtaagccaccacgcccggcccatcattgacttttactcaaccttttcctgtaaactaaatttggagtcctgggaactgcccttactgcttttctacttttctgccttaatgcaagactttacttttttgtttgtttatttgtttgtttttgagacagagtctcactccgtcgcacaggctagagttcagtggtgtggtctcagctcactgcagcctctgcccccagactcaagcaagcctcctgcctcagcctcttaagtagctgggactatgagactacaggcacacaccagcatgcctggctattatttttatttttgttagagatgaggttttaccatgttgcccaggctggtctcaaactcctgagcccaagcaatcgtcccttctctgcctcccaaaattcagggattataggtgtgagccaccttgcctggcctctggttttctttttgggtctttctcatcccctcatcgtttcacctatctctgcacattattgagtactcactttaattgtcaatgagtttgggatctcttctgcatatttctttatcattgtggtctttccttataacactttttagacttttctttttcacttgtttttattctatctttcaaagtacaatgttaggcatgagggcgcagaaactgtgctacctttattctctgaaaatccagcacttacctgtggtttgcattaatcactctacaaatattttttgaagaaatgaaccatactatcttgtgggttgcacaatgaaggccttactttaaccaaccctgttttcaaaatctccctagtaaacctctttggtctttaatgataataacattcacatacttgtgatagtatagaaatatatgattttctaatggcaagtccttttttttgacctcccatattcccctcactctgagttaaacactctgaaagaaacatatccagccattccttctgaaaatgtcaagcaaacaaatgaaacaagaatatgttcaccttaggcaagggtttggctggtttacagtgaagtcctccaacaaaatcaacatttggtaagaatgggcgaggaaattcaaaatcccaataggttcgaatgagccacatttcagctttccccattgtctcaaataatgtagtgggtcttcctgatggaaaaaaacaaaacaaaacaaaaggtagctaacacgagaattgttattttaatattgaatatgcaggtattttcctgaaaggacttggaataacatacctaaaaatatataaaatgtctgcacattgataatatatataaatacatttatataatataatacattatattaaatacattatattaaattaatgtatattaaataatattaaatacattatattaaattaatgtatttaatatatgttaatatattttaatttaatagtatttaatttttaatttttaatatttaataaagtttaatatttaatattaataaaattttattaattttattttattaataaaacattaataaagttaataaaattaaacaatatttaatatttaatttaatatttaatatttaatagttttaatttaatatttaaattatttaataaaataatttaatataatgtaaatacattatattaaatacatttatatagtcatcatttaatttttatgtattgcatatgttgctcatatgtatatataaggaaggcaaagtgttcagagagctgtaagaagaaatcacatctttaatgtaacatcagtatattcacaatcataaataattattaaaataagtcactaatatggtttgactgtccccacccaaatctcctctcatcttgaattataatccccataatccccatgtgtcgagggagggacccagtggcaggtgattggatcatggtgtggattcctccatgctgttctcatgatattgagtgagctctcatgagatctgatagttttataagtgtctggtatttcccctgcttgcacttctctctcctgccactaagtgagaagatccaagcttgcttccccttagcctttcaccatgattctaagtttcttgaggcatcccagtcatgtagaactgagtctattaaacttcttttctttataaattgcccagtctcaggtatttctttacagcagtgtgagaatggactaatgtagccactatgaacttaaatacacatttgtcttccctctgaagctgcaatagtaacaaatatacctttaaacaactctttcagttccacaattaattcatcttaccttacccatgaaaacagctttccaggaagtactctagtgtctacagtttattaagctagtcccttgatccttggttctcaaagtaaaccatgagttttttgagctcaacactgaaatctttacacctactactgtcttggttcatcttaagatcttaatataattagatttttaaaataaatatatttacaaatgagaattaaaaatttttcagaatttattgacatagagatatgtgctcttccttattttggcccctattttctttgatggagagatgcagtttaataaaatatagattaaaacttagatgttcactttcaacaagatttcagtttttgaaggaaataattgtgaagttgttattgaaggaatgtataaatattagaaatctcaagttttaggcttctgtttctggagtagagccactatatttctcaactgtgaaggaatccttcttatatgaaaaacaaaatttaatttctaaatgaggaaactgaggtactcaggtacaagttcctcaatcctgcattgataatatttttagaaatatgtgtaaatataaaatttgtatgtctgccttcatgaagatgtttcttgaagtatctattgacttttttaaagatgaaaaaatgtatagcaaaatgatatgtgatggcttaaagaaatcataagtgttttacattgaaggtttatgactctcttggtgtcctatagcagtgatggcaccagggttctaactgattctataaggtcaacattctatatttttgagactcatagatcatcttacatttgcaattcataatttcccataaaaacactatcttctgacattatatttatataagcccaccttcaaaggcacaggaaaattagaacttaataaacaccaattggacacacgacttacctagaacttcactataaaactggtcccacttcttcagatcatatgcttgaaaccaaaagtcaaaataaagcatatatatcatattttttatcctctccatgaaaatcatttgatcacttaattctgacataacaacaggtacataggaaggagggaacagaaatcctccaccattcttctcaactgtgtagccaacagagaagcggagactgtacagaaagggtatgttaagtagctcagccagcagctcaccacagggattaacggcatctgccagaaggacatcaaattttgactcttgtagttttctcataagtttcttgttcaaaactgcatcttcacagagctttatattatagtcagaatattcccaacacaattcttgtagttgtgaaaaatatgaccaaaatgtattttttgaaatactatatgtccatctatcgaacattttcataaaaaaatcttccaaatcatttttagttaaagatgtaggataaacttctaatttaatagcagatgatttactggcattgacaagaatagaagccgaagatgtcaacacaatcacctcatgacccctctgaacaagctcttccaggattgtcttcatatttatccaatggctgtattctgtgggccacaccagcacctttccacaactcccagagctaaagtaacaactgagctgcatcagcagaaagactgacatccatttcagagacatcctggtcttatgcagtgcttcttttccagttgttgtttctttctgtcatttctcatacttatatctgaggaaaaatcaatcaagttaaaatataactgctaaaatttgagttgacctcatatttattttagtgtgtttggtgttcttttatatttacaattactctagtcaagcaataatttttatgacctagaatacgtaagtaacctgtcttatgtaattattttataatactgttaagaacagtggcaggtgagaggctcctgcctgttcggtgcccttgacatagagagaagaagtaattatacaactcaaacgccattttttaatatcgtggtgcaagtaatgtcttctaaaactttgttgacacataattcatataccatatgactcaccaattagtgtgtacagttcaatgtttcctagtatattcacagaattttactttcactacaataatcagtattatctccaaaagattctatacaatagcctctaaccccccactctgaaattttgcatccatcctaccctaggcaaccactaatctaatttctatctctatagattagcattttctggaccctttaaaaaataaatgagggttttccagtgatcatggcagatgggatgcaggactagattgcagctccagacagagcagcatgcagaggcttgcattgtgaattttagctgcaggtcaactgcaaggacagaccagcaattctgagaggatccacacaccctctgcaggaagcgtactgctcctgcaggacctgggagacatcccaaacactgtgagtgccccaacaatggaagtgggaaagggtgatccccctctccagaatacacatccccactggagaagctgaagttctgtttgcaggagaagttcctgactttatgtgaagctgagtcaaattagagaaccaagccaagcaaaatataggggtagaggaagtagcagaaaggtactgggagctctctggatacccaagcagctcattcctgcctggcaccacagtgatcctttaggagggtggccagcggagcagggggttcaaagattcttctggggcctgaaagcttgaagggatgagtaactcctcccttctcaggcccagtcccaagatgcaaggctgcttgcatcagcagcgtgtgtcagcaagatagcagaagcaggaagagagccggccagaagacacctaccctggctggagacatgaacccttgaagatcaagaggccatccagatactacatagcagtcacgttagattgggacacttactctttacagagaactataaaaccactgtcccatcctcacttggggctgatgccattttaggcctcagcccacctgcacccaggcactcattaaaacagcacgctgctccgcactgcctcgtgttgtctgttggcatgctctcagggatcaaaccaattcaagaaccttatatctggtgccaaaacctgggtggggctcaggtctgtgtcccttgtggacctacccctccaccccagagagcaagccacagcaaccagacaaaggaaactcctcagcctccagttgcctctctgtgcatgtgtagcaggatgagccacagacaaaacttctcagacaccaagttgtagaaggaagggctttattcagctgggagcatcggcaagctactgccttaaaatccaagctcctcaagtgcgcaatttttgtcctttttaagggctcacaacactaaagatttcacatgaaatggtcgtgattgatttaagcaagcagtgggtatgtgacaggtgctgcatgcactgctggtcagagagaaacagaacagggcagggggttttacagtgttcttctgtacaatgtctggaatctctgaataacatcggtttctaagttatgagttgatttttaactactgggtttaggtcaggcaggcccaggcctggtttcaggcctggagccaggctgcctgtctttggttttacttctttgttgttttttcttaaaacaggtactgagcataaaacaatataaaataatctgagagggtccttctcttccttcattccccccttttgagactctcactttttattagtgggagttctcactcatttttttacttatgtctttttgtggaatagactgatagtgattcatatagtacagttgtgctgaagcattttgttgaactaaggtagcgatgaagctttttatcatttgaagaagtacaggtagcaaacaagggagcagtaagcaggtttttataattattgtaactcctattataagagttttaaatttttctagtgctgggaaccactttctaaacatggcttcagggttgaatccgtgctacacttgcacaggtacatgtgccagttttgtcatatttttaactatgtctttaataacttgcctgattatctatgtgtagacagtaattagtaaggttaaatttttcacaaactcctccttcagctgctagcaagtagtcaagagctagtctattttgatagattgcatttctcatctgagtctcttgccgggcaagaacggtcaaggcttgaccggttttattagtaaaaatttctaaaacagcttgtaaccatatgattcggttgagcatgtagatgggggtccaatatcctcatgagccatcttgtgcctaagtggcgggtccatagtattgtatgatttttttcagggggctatttatcatcttttcctatggctatgcttcatttttttgttcccaggaagcatagactgggaagcctagaagttcatgtttttatgggcagtaagaagaaagaaggcttaatggtgcgaattacacagctacctgtctactgatcaggcagcttagcataagctttgtgtccacatatatccagtataatccggtgggggccgtccagtcccagtggaattctgggtgggcccaaacagtctgcaactttggaaatttactgaatggatttctttctgtgtaattggaactccaccatgtgactgtttttgtggtactattatagagcttttgtctaagacagctaagctgccttacaggatgagtgaatccttttccttctttagctatgcaatactgtctaataattgagacttttagaacctagagatgatcagggtgattcttttgggctgggaattcatcaggaaatgggtctgtaggaactaattcttgggcttcctatggccattgatctactgttatggttcctccacaaacataatatgaggtgacttgtagagactgggctacgtgttaggctaattgcaaaaagaaatttttagtttttcctggaatctcaggtactggcacatttagttcatcatagaaagtctgaaacactggttctggagagcgtttttgaacctctccttttattaggatgcttacattaggatctagtccctttttatccatgtctaatgatatatatttttcttttattttactttgggtctgaggggtttgtgattatcaattctaaaaggttgtagctcctattcatgcaagaggggctgagttttcctttttggagtcaaacacgatcttttttattttccttttaagtagtctgaatgacacgagaccagtattgacacatctcacataaatatgatttttgacagatatacttattttttttactgtgtaactttcttttttaatttagagaatcacatcctgtttcatgctgcttactattaatagcggcacaagtgtcaaattttaaggttacattttgaggagctctgtttttttcggttctacctattaccttacttgtgtcacatagaaaaggagcagtccttaattttattttaaaaactgtgatcatgggaggcttaaaattgttcataacacacatcaggttggttatttcctgggctacataccttggatagaatagcattatacaaacaatttgttgttgtttttgttgctatttaatttttttagagtcctcgggcgtccgtgatattagtgttagtcagttttgttgtgagtgttagaaagagggcatatagaaccaggaagctgataagaaagacgattatgagggcgtgatcatggaaggcaattagctcttttataataaccataaagtaattagctcttttataataactataaagtaataggactgtagcaatcttttgttccacctcagtgacttgatgtatatactggaaacagttcttagtctgaggaaggtcagttgaagtccttcctgtacaagtccaaattctgaggaaaatgagtcctgcgatgagtctcctcatgcttcagccatgcgtggaccagtcagcttctgggtgtgactggagcagtgtttgttgtcttcttcagagtcattttgcagggattggtgaagctgctcccatccacgtacagctcccagtctactgatgtacagttatgtttaactgggctctctgataataggagtaagatagtgagcttagggtgttgcaaacttcaatggttatgtggggattttcacaatgcaagctttggtatctagttagtctatcatttattagctaatgatgtcctttggtatttattaaaattaccacagcatggggagactttatgtttaggtttttcctaagagttagcttatttgcttcttgtgttaacagggctgttgctgccagggcccttggacatgggggccagcctttggaaaccccgtctagttgttttgagagacaggccattggccttggccaggaacctccagtctgggttaaaactccaactgccatttttttctctttctgacacatagagtgtgaagagttttgtcaggtcaggtagcctcagggctggggccgacatgagttttttttttttttttaactcatgaaaagctctttgctgttggttgtaatagatgtagtttatctaatctacatttttattgactgttatctactaaaatattgacttaaatcttgtaactatttgatttcaagctttaaattgatctggtattccttgcagggcttcgattgcatctaaatagatgtgagagttgaaagacttataaggggctcctctcactttacgatgtgttattattattttttccttcctctggttgatgaaatgccagggtgaaagggatagcccaatggactaaggcacaaatgccactctagttatttggcagagtgcctagtaaaggtccaccacaatactaccacacatctgctcagggatgaacaagggctgattgattgataagctcttgaaaattcttaagctcactgcatccttttaggtctccaaggaatgctaagtttcctccctgccgtgagagacaggaagtgaacttagtgttgagagacagaagctggatggcccttgggggctgactggcagggacttcaggatatagcagagagagcttggcatgacttattactccaggctgtagaatcctggaaaagagctaccatcaggcccacacctggtgaactggaggaccaccgtagtgggaaggggacaattagggcctctggcctgccatgtgcacaagcataacaattgcttttgtttattgtgtagttggaatatttgatccatttcaaccaggcatttgtagcttgatatactgtcttaattgctaaagtttgttttaagtctttaacttttatgatcctctagtaaaatgaatatttccattagcactaatttttattagtttttagaccaaagaaagctaaacatcattttatatttaatgtttcttgtatgatttttataccagataagctaaattttacttttatattagtgtgttattaatattaaacttaattttaataaaaccttgtagacatatttatccaatttttcatagttgaccataaggtaagattttatagactctgtttaaccttttacaatttttgttaaagagcaggttgatgctttaaggaaaaaacctgttgcatttttactttcatgtctagttcacagaaaaactggataatacttttttaactttagctaataagtttacacacagaattttctttaaattaacattttaaaacttgcttgaacttttcaaacaataattcttttttgactttttaatgtaggtaaaaatccacattcttatgcctccttataatcttctcattaaagttatattttacttttttatacacctgcacataaactgtttcttcaatagcactcaggaggccttattacttttaaattatgcaacattttttgcataaaattttttataactttttttcacgactttcgccaacaatttttcaacatgtctcaactttctgacttattacaaacatttttttcttctctttaaacaacaagttaatttatttcaggacaagaatttaccatataacactctttttacataaattttacctcctccccccccttttttttttgaagataaccattccttttttttaaaaagtgaactttctttatgtctttggactagactgtctaaggccacaagattagaagttaccataatatgtgttacactgtcaacttttagcaaacttcgcttttgttgaaaaccttgtaagtttgaaatttcaattatcctttgctattaataagaccttgtttagtctaaatttacttagaattggtatagatggccttttttttttttttctctgctggtctttccttgcctctgccagctgcttatgctgctgttctcttaactattgtgagggggggtggggggaaggggtctaaaaccagctgtaactgtctatgtacagaacctggtctgggtgccttggcttacaggttaccttgtgccataccttagaaactaaaaagacctatctaggcttccttctgatggctaacctacctctaatgctggccaatctatttcacacaaagttctaagttttcctggagtcatagtgactccatagtctctattaaatcctttcttgaaattcattatcatagttcccagtgcagtgggcttactttgtgcctgatctatgtttttttgagacaaaacaccatgctcacagcacacacacaccacaaaacaaagaacgggtaaaagggcacacacaaacatttcagtttacaccaaaccaaaatcaaaaccaaaatcagagtatccagaaatccaagccaggtcaaaaaccaaaaccaaagtatccagcaattcaagtcaagtcaaaaccagatcaaaagtgccaatacaggcacaccgtgggtgatcaggctatgctacacttccattcaggtggagtggggcaagttcaaaagactagtcctaccaagtctagccaagtcaaaaccagaacaaaggtgccaacacaggcacaccgtgggtgaccaggccatgcttctactcaggtggagtgggacaagttcaaaagactagtcttaccaagttccagatgtccagactccaagtgccagttccttcccggtgttcagccactgtgttaatcctccacgggggcctgctacgtgttgatctggtgaggtgttccactggggcaatttcctacccaggagcgctctttggatctcatcactcaggctgcccggagtaccccacagggatgctccacagggcaggcttaagccacctaaggggctgcctcagccttccgtcagtcaccttgcttctgggtcagggagccaagaaatgtagcaggacgagccacagacaaaacctctcagacatcgagttgtagaaggaagggctttattcagctgggaacattggcaagatactgccttaaaatctgagctccccgagtgcacaatttctgtcctttttaagggctcactacactaaagatttcacatgaaagggtcgtgattgatttgagcaagcagtgggtatgtgacaggggctgcatgcactggtggtcagagagaaacagaacagggcagggagtttcacaatgttcttctatacatgtctggaatctatgaataacattggtttctaagttatgagttgagttttaactactaagtttaggccaggcaggcccaggcatagtttcagtcctggcgtttgggctgcctgtctttggttttacttccttgttgttttttcttaaacatgtactgagtgaaaaacaatataaaataatatgagaaggtctttctcttccttcacatgcacattggtcactgatctcgcctactgttaggcttccctgggagcccagttaacaggggaaaatctgcatgacctctcttggtttctcctgtcccaaaatccaacactgatccaagaaggctccagtatgtgccaggcactccctgatcatctggtcttagggggacgcctctaagccatttgattccgttccaggaaccaaaaaggcagaggtgataatagctccttttattgtcttcctccagctgtccaggacagtcttctttttccctgttctccagagcctaccctttgatatggaaaactccccatcctccattccaaaaaacagccctccagactgcctcataaaaaatctgcaaaccttaggcctcaggcaagatacccaccctaagcgccttgtcttttttatacaataaaacctggccgcagtatgaattagataacgggtccaaatggccagcaaatgaaacacttgactttacaattttaactggttaaagcaattattgccgatgactggaaaaatggggagaaattccttgttccaggcctttttgcactcagatcacaacctgacttctgcaattcttgcttacctgttcaaatccttcattctcaccgccctcataacctttctcctcctgaccctacctctttttccttgttggatccagcagactgctgtccacccctcccagcccctacccccacgtctcaaccatcttctataactccccaagctttctcattgtcttcgcagtcaccatcttcccagccaccatcttcccagccggcatcacctccaaaagtacccacttctttttctacaccgtcctctcctcaggaaaactctagcattgcctgtactcagtctccttcctcactgccctctcctgaagcctgtaaacccatcaagccaccttacacccctatgtatcctccactgcctgtcaactcaacccgccttcccccttcaaaccctcagcaggaaccccttctggcttctttcttctctcctgtccataccagcttgggcaccatctttggcccacgctgcacccatacttcagtgcgggtgctagaatgcccccttcaggaagtagcaggaactgaaggtattgttagagttcatgttcccttctccttcactgatctctcaaactaacaagactcagttcatttccagaagaccctacctcttatattagggagtttcagtaccttacccagtcttatgcactaacctggtatgacctctacttatcctgtcttccaccctcaccttctacttatcctctcttccaccctcaccccagaagacagggaccatatttggaccctggttcaggagcatgctaatacaattcatcatcaagctcctgcccagcctactggcacggaggcagtccccaaccaggagccccaccaggattatcaagacagggcctctggacactgccatcaagaccacatgattgtgtatctccttgcaggactcaaaaagggtgcccataaagtggtaaactataaaaacctttcagaaatcacccaaggtcctgacagaaacccagccttttttctctcttgtttaactgaagccatgagaaaatataccaacctagacccagccaacccagaaggaatcactattttaaacctttggttcctcatccaatctacccctgatatttggtgcaagattcagaagcttgacaatggccctgaaaccccacaatgacaccttcttaatttagtcttcaaagtctttaacagttataacgaggaaagtaaaagaaaaaaaaaaaagacagagtttcaaatgcttgcctccaccatcacgggccctgcaggcccacaggctgcagctccacacagatgcctcctagcaatccacctccccctggcacctgtttcaagtgtggcaatgaaggccactggtccaggcaatgcccaaacccaggtaagcccaccaggctgtgccctctctgcggaggaccccactggaagtcagactgtgaggtgccccagcaaggaccgcccccatccctgccccagccggccaaaacctcctactaggatctcatcagccttgccgctgaagactgacagtgccctggaacagatgccccagcaactaccattgcttcatctgagccaaggataaccttgatgttggcagataggccagtattttttttttaattaatattggggcaacctactctgctttacctaaattttcaggacccacccagtcctcccaagtctctgttgtgggaatcaatggacaagtctccaaaccccaagacccccctccacttttctgctccctgcacaccttttccttcagtcactctttcttagtcctgccttcatgcccagctctgctcctaggcagagatattctttcaaaactccacactactctccacttccacattccccatagtacccaacacatcaacccagacccctccaaggcttctaacaggcttctaactttcttctactcctccgacctcccaccctgaagcatgcaacttttccttatcccgcacctgtagttaaccccactgtttgggatacttccacaccctcggtcacagagcaccacacccccatccacatcacccttaaagagcccaccccgttcctatcacagaagcagtatctcatcccccaagcagctctcataggcctaaagcctatcatttctctcctcctcaccagtcacctactctgcccaacaaactctccttttaacacatcagttctacctgttaaaaagccagatggaacttatcacttagtccaggacctcaggctcattaaccaagctgtactcccagtgtgtccagtagtttctaacccatatactttactttcctcacttccctcgaataccacccatttttctgttctaaacctaaatgatgctttttcacaattcctttacaccctgattcccaaaatctctttgcctttacctgggagaaccccgacacccacctttcaggtcagctcacctcgtgtgtactacctcaaggttttagagacagcccccacctttttggacaggcccttgctagtaacttctgtactttatccctaaaatcatcctctcttctttaatatgttaataatctgctcctgtgtagcccctctcaaagagactgcaacacccatacatactatctctcttttaaacctcttggcagaacaggggtatcaggtctcccctaagaaagcccaaatatgcaccccccagtcacctatctaggcctagctctcactcctgaacgcaagggctcacaacagaccacatattccctccttcagtccctcccgcctccacaaactaagcaagaaattctctcttttccaggattagcgggatattttaggctctgggtttcctccttcgctttacttgccaaaaaattatacgaagctgttaaagtccctctctatgagcctttaaaacctgcacagcctattacccaacctttccatctactccaaaagtctctcatctcagcccccatcctcactctcccagacttcaccaaacctttctccctttatactgatgaatggcgtggagttgcactaggtgttctaacccagtctaaggggcccacccggccaggttgttgcctacctccctaaagagcttgagaccacagttcttggatggcctgcctgcccctgagcattggtggcagctgctctcctcactcttaaaagcctaatactatctcttcatgccaacctaacagtttattcaacccataacatcaaagacatgttagctcaccgcagtgtactaagtcttttctctgccccacggctcctccagctgtatgctctattcatagaaactccccacatcaccatgctaaccacctcccatctaaacctgtccatgctcttacctgaagctacaactgcccaagactctacactcttctgtgtgaatactgttcaaacctttcttataccttttccatacctaacagaccaatcccttccagatgcctcctttatttggtttgtacatggcagctccttcctacatcaaggacactgacatgggggctatgctatagtgtcaccccccaacactattgaagccaatccgctcctcttaggcaccacctcccaaaaagctgaattcaatgccctcactccagctctcactctagcatccggaaaacagatcaatttattcaaattctcattatgcgctccacgtagtgcactcacactcatccatctggaaagaacggggtttcctaactgcaaacaatactcctgtcataagacaagtcttctagtccttgtctgtactttctctgggtaggtagaagaattcccaacaacttcagaaggtgcaactgtcatcgcacaaactcatcatgcatacctgcaattccccgttttggactcccaacatccatccagtctgataacagtcctgccttcatcagccaaattacccgaggcatctctacatccttaagaataaagtaagctctccacacaccctacaggcctcaatcttcaggcgaagttagaaaaattaactctgtctttaaagcccaactcaccaagctggctgtagaaacccaacagtcgtggacaaaaaaaatctccctttcgccctcataagactttgcacaacaccaaaagcacactctttttatagtccctttgaaatcatgtatgaccaaaattttgtcttggggcctccacccttaccagactctgagccactcagaaattaccacccctccttaatccagacatggtctttcatttgtgaagcagcaaatgagccatgcctctccctgtcgacacctcctggtcctctcaacataactgacttgcaggcacagacatgtttccagacaatacagatggtgctcctgctacagcgacatggtggataccaacctgtctctcaagaataccccaaaaattaagttttttttttccaaggtgcccactccaatccctgtgtcatgcctgaagtagttactgagaaagtcaccccttttccctttattctataaccaaataaacaggaagattctccctggggcctgaaagcttgaagggatgagtaactcctcctctcaggcccagttccaagatgcaaagccatttgtgtcaacagcttgcatcagaaagatagcagaagcaggaagagagccaactggaagacacctaccctggctggaagacacatacccctgaagatcaagaaagagaccgtctgggtactacatagcagtcacatcagactgggacacttactgtttacagaggactacaaaacccctgtcccatcctcacttggggctgacgcccctttaggccctagcccacctgcacccaggtgctcattaaaacagcatgttgctccacaccacctcgtggtttctgttggcatgctctcagggtttgaaccgatacaagaacattacaggggtaaaactccacagtaagagggacttctctagctgaactttgtaacaatttgaacaggcaagaagcctcatggccagaaattgggggagggcatgaatctagcttgcagacttcacaggcaggggaagaactaaagcccttttctttgcagctgggaggtggaaaatctcaggcaaatattcaagtccaactctccctcctccttgaaaaagactcgggactattgcaggggccacggtggaagtgggagtggcccttcagtgtgcatgggaggtgggttagaactgagactgctggctttcccacacttccctgacgacctcatgactcagcagaggcagccaaaatccacctaggtacacaactccagtgacctgagaatctcacctccatccccagcagtagccaaagcaaggccctcccaaggaaggtctgagctcaaacacgcctggacctggcccacctggtggtccttccctacccccctggtagcagaagacagaggacctacaatcttgggagttgtagggccgtgaccaccaccagtccctctccacaatactacagctgatgctttctggaaagtaccacctcctggcagaaggccaatcagcagaaaatagagcattaagccaccaaagctaaggacccccacagagtcctttgcaccctccacctgaacaggcactggtatccacagctgagagatccatagatatttcatatcacaggactctgcagacaacccccagtaccagcctggagctggatagacttgctgggtggctagacccagaagagagacaacaatcactgtaatttggctcacaggaagccacatccacaaaaaaaggggagagtaccacaacaagggaacaccccataggacaaaaaaatctgaacaacagtcttcagccctagaccttccctctgacagagcctacacaaatgagaaggaaccagaaaaccaacctgggaatatgataaaacaaagctcgttaataccccccccaaaaatcacactagttcaccagtaacagacctaaaccaagaagtccctgatttacctgaaaaagaattcaggaggttagttatgaagctaatcagggagggaacagagaaaggcaaagcccaatgcaaggaaatccaaaacataatacaagaagtgaggagagaaatattcaatgaaatagatagctgaaagacaaaacaataaaaaattcaggaaactttggacacacttttagaaatgcaaaatgctcaggaaagtctcagcaatataatagaacagatagatgaaagaaattcagagttcaaagacaaggtcttcaattaacttgttccaataaagaaaaagaaaaaagaaaaagaaaatatgaacaaagtctccaagaagtctaagattacgttaaataaccaaatctaacagtaatcggtattcctgaggaagaagacaattcgaaaagtttggaaacatatttgggagaataattgaggaaaacttccccagtcttgctagagacctatacaagaagcacaaagaacacctgggaaattcatcacaaaaagatcttcacctaggcacattttcatcaggttattcaaagttaagatgaaggaaagaagctgggcatattggctcacgcctgtaatcccagacctgatcaggtggtcggaggtgggtggacaacctgaagtcaggagttcgagaccagcctgaccaacatggagaaaccctgtctctactaaaaatacaaaactttgctgggtgcggtggcacatgcctctaatcccagctactcgggaggctgaggcaggagaatcacttgaacccaagaggtagaggttgtggtgagatcatgccattgcactctaacctgggcaacaagagtgaaactccatctcaaaataaaaaaaaaaaaaagatgaaggaaagaatcttaagagttgtgagagagaagcaccaggtaacctacaaaggacaacctatttgattaacagcagatttctcagcagaaaccctataagctagaaaggattagggccctatcttcagcctcttcaaacaaacaattatcagccaagaattttgtatccagtgaaactaagcatcatatatgaagggaagatagccgttttcagacaaacaaatgctgacagaattcgccattaccaagctaccactacaagaactgttaaaggaactctaaatcttgaaacaaattctggaaacacatcaaaacagaatatctttaaaacataaatcacacaggacccaaaagatcattcaaggctgctatgaacacctttatgcacataaactagaaacttagaagagatggataaatttctggaaaaatacaagcctcctaacttgaatcaggaagaattaaatacactgaacataccaataagaagcagcaaggttgaaatggtaatttaaaaattaccaacaacaaaaagtccaggaccagacagattcacagcagaattctaccagacattcaaagaagaattggcaccaatccttttgacattattccacaagacagagaaaagaggaaccctccctaattcattctatgaagccagcatctccctaaaaccaaaaccaaaaaaggacacaaccaaaaaaggaaactacagacctatatccttaatgaacatagatgctaaaatccttaacatgatactagctaaccgaatccaacaacatatcaaaaagataatccaccgtgataacgtgagttttacaccagggatgcagggatggtttaacatacacaagtcaatatatgtgatacatcacataaacagaattaaaaacaaacatcacatgatcatctcaatagatgcagaaaaagtgtttgacaaaatccagcatcattttatgattaaaactctcagcaaaactgacatacaggggaataccttaatataataaaagccatctatgacaaacccacagccaacgtaatactgaatgggaaaaagttgaaagcgttccctctgagaaagggaagaagacaaggatgcccactctcaccactcctcttcaacatagtactagaaatcctagccagagcaatcagaaaagagaaagaaataaaggacatccaaatcagtaaagaagaagtcaaactgtccctgtttgctaacaatatcattgtttaccttgaaaatcctaaggactcctccagaaagcacctagaactggtaaaggaattccacaaagtgtccagatgcaagattaatgtacacaaatgagtagatcttctatacaccaaaggcaaccaagcagagaatcaaatcaagaactcaaccccttttacaatagctgcaaaaaagtaaagtagagtaaaatacttaggaatatacctaacaaaggagtcaaaagacctgtctacaaggaaaactacaaatcactgctgaaagaaatcatagatgacacaaacagatggaaaaacatcccatgctcatggatgggtagaatcaatattgtgaaaatgatcatactgccaaaagcaatctacaaattcaatgcaatctccatcaaaataccacgatcattcttcacagagttagaataaacaattctaaaattcatatggaaccaaaaaagggcccacacagccaaagcaagactaagcaaaaagaacaaatctggagccatcacactacttgatttcaaactgtactctagggccatagtcaccaaaacagagtggtactggtataaaaacaggcacatagatgaatggaacagaatagagaaccccaaaacaacacaaatacttacagccaactgatctttgatgaagtaaacggaaacataaagtggggaaaggacacccttttcaacaaatggtactgggataattggctagccacatgtaggagaatgaaactggatccttatctctcaccttatacaacaatcacctcaaaatggattaaagacttaaacctaagacctgaaactgtaactctagaaggtaacattgggaaaacccttctagacgttggcttaggcaaggatttcatgaccaaaaacccaaaagaaaagcagtaaaaccaaagctaaatagctgggatctaattaaactaacttttgcacagcaaaaggagcaggcagcagagtaaacagacaacccacagagtgggagaaaatcttctcaatctatacatctgacaaagtactaatatccaggatctacaacgaattcaaacaaatcagtaagaaaaaaaaaaccccaataaaaagtgggctaaggacatgaatagacaattctcaaaataagtatacaaatgaccaagaaacatatgaaaaaagtgctcgacatcgctaatgatcaggcacatgcaaatcaaaaccacaatgcaatactaccttactccttcaagaatggccatagtaaaaaaatcaaaatacagtagatgttggcatggatgcagtgatcagggaacacttctacactgctggtgagagtgtaaactagtacagccactatggaaaacagtgtgacgattccttaaagaactaaaagaactaccatttgatctggcaatcccacttctgggtatttacccagaggaaaagaagtcattattcaaaaaagatacttgcacatgcatgtttatagtagcacaattcacaactacaaaattatggaaccaacccaaatgtccatcagtcaatgagtggataaagaaactggtatatccatatgatggaatattactcagccataaaaattaatgaattagtagcatttgcaatgatctgaatgagattggagattattattttaagtgaagtaactcaggagtggaaaaccaaacatcatctgttctcaatgataatgtgggagctaagctatgaggacacaaaggcataagaatgttacaatggattttagggacttgagcagaagagtgtgaggaagcaagggataaacgacaacatatgtggtacagtatgtactgcttgggtgatgggtgcaccaggatttcacaaatcaccactaaagaacttatgtaaccaaataccgcctgcacgccaaaaacctatggaaaaataaaaaaaatttaaaaaatgaaatcatacaatgtatggtctttagtgagtggcttcttgtgcttagcataatgtattaaaggttcacccatggaagagtgtatataaggacttcatttctttctattgtcaaatagtactccaaagtgcatatatactcattttatttgttcatttatcagttggtagacatagattttttccatttttgatgattatgaataatattgattaacatttatgtacaagttttctgtggacatatttttatttctcttgggtgtatatctagaagtggaattactggattacatggtaaatgtatatgtaaccttttgaggaattgctaactgtttttcacagtggcagaattattttccattctcaccaccaatgcatgatggctttaatgtctccataaccttgtcaatggttgttatcctatgttttttgattacagccagtgtgagtgaagtgatatctcattatgatttatatttccttcatatctaacaatattgagcattcttatgtgctaatttcccattatatattttcttagaaaaatttctattttgatactttgcccattttgattatttgtcctccttttatggacttatgcatttaataaatttttgacataagtcccttgtcacatatatgatatccaagtatattatcttatttttttggttgtctttttactttcttaatgatgtccattgaaacacaaaaatattaattttgatgaaatcctatgaatcaacttgaattgggtcacttttatttttagtgtcatatctactaaactatccccaaatgcaaaatcatggacattagcaaccatgtttcattattagagttttacagttctattgcttacatttagcttttaacttattttgagttaatttttgtaagtggtttgaggtagggggccaacctctattatttcgtatatggataatcagttttctcaattacatttgttgaataatctattctttgactcattaaattgggcactttggtcaaaaaccataaatgcgtgagtatattcctagattccaaaatctattacactgatttgtatgcctaccttatgtctgtatcacactctcttgattattgtatattggtatttgtctttaaaagcagaaagtgtaagccttccaactttgttttttattttaaattgtttcagctatttttttttcttctagcttttttttttttttttttttttttttaaggcaggggtctcactacatttcccaggctgaactagaagtcctgggctccagcaatcaatgaatttcagccacctgagtagctggggctacaggtgcatgccactacatctaaattgtttcagttattactgtctcctacatatctacatacattttagaatcagctagtcaatttatgcaagaagttatctgggattttaatagggattgaattgaatctgcataacaatttggggagcagagtatgggcattgtcacaatattaggtgtttcaatacatgagtataagatgccttttcatttatttagatatcatttaatttatttccataatgttttgtagatttcacagggcaagttttactctccttttgttaaatttattgatggccaggcgtggtgactcacacctgtaatcccagcactttgggaggcctaggtgggcagatcacaaggtcaggggttcgagatcagcccgacctacatggtgaaaccccgtctctactaaaaatacaaaaattagccaggtgtggtggtgcatgcctgtaaccccagctactcaggaggccaaggcaggagaattgcttgaacccaggaggtgaaggttgcagtgagccgagatcatgccactgcactccagcctgggctacagagtgagactccatctcaaaaaaaaaaaaaaaaaaaagagaaaaaaattattcacgaactgtatttttgtgctattttaattgtgattgttttaatcgttattttagcctaaatttttattgcaattagggagaaataactttttttttattgatcctatatcctaaaaccttgctttattggtttactgctctaatatttttctagcggatttgtaaatgtttactattataacattatgacaaaagccaataaagatagcttaacttgtttatttctagtatggagtcttttattctttcattttttaaaccaatttatcttatctagaacctctaatacagtgttgaatggaagtgagaaaagccaatttagtctttctccattaagtgcggtgtcagtgtgtgttttatttatagatactatttgtcagtttaaggatgtttctgaaaggtattgcattaatcacatgattttttctgcctttattaaaatgattatgcagttattgtccttattctaatgatattacatattcaccagttttttgagatgttaaagttagtttgcatttctggcataaaattcccttctggttaaagttagtttgcatttctggcataaaattcccttctgtatgtccaaagctttttgcacatgctagggttctgtttgctagtgtgaaagaaaaataaagaatcaagatcctaaagtcactatgccaaagggaaaaaagtttagcttgggaactgagtcacacaaactgtcagaggcattctaaccagagtgattccaccttgaataagtcagacaaggtcaaacctgccaggttacattcccaggggattgagcactcttggttacaagatactcatggttgagggaatgagttaatgatgataattaactaaataaagacccagaacttatgaaaatgtcccaatagtttgaaaacaaaaacttcttaatttaagaattagttttcctttaaaaaactagcccacttgtaaaatcttgctgaaatcaataatacataggaaaataacaatattaatagcctgtcacaagctgatcacaaacctttgtaataaagtacagtattcttaacaacctatataagcaagcactaagtttaaggtaggggtatttctcttcttgctttctgaggatgccctattctgtaatagagtagtctctaacaaactgttaattttactgtactctgcgactcaccttgcattctttcccacatgagatccacaaacccacccttaacgtctgggacaagaccacttttccagtaatattttcctctggtgactctgctgggacctaaatgaggtgagattccaacccaaaggaaatagactatgcaacaccaattggctgatttgggtaagtggtggaacatatttttatactcgaacagagacactgttcaaaatcggtttagaggcccaacttaggacagttagaggcccttctgacagataagaggtttagaggcctttccgaaagctaagggggttagaagcccttcacaacaagaaatgggttcaatgctacaaaatgttaattactactccctttcaattagccctccctgtgctctctgtcattcactaaagactgtctgctgtctgccaattttctgactgctgactatacttactgtttctttgcagagaccttgcttgatggtcctgagatttttaactttcacgttcctcatttgtctttggattagtggccctttacttgtgtgcttcggcatgttgctaaaagacattagagatgaatggctctgcaagatttactttccctatatctagcccattcgaatgaattatttattgtctcatctctcaaaagattaattgaaatttggtacttacaagttttggtccagtgtgcacgatttagcccagtagcaattatgccaatctcccatgggtgaacagctcccagaaggagaactggagatttctttttggaaattctttttcatcccctcactaatcaactgacctttatttcttgattatgaacagcatgatcatgtaagttttaccctacttaccattactatccttaacctggacattcctctctggatgcatatcatttcccttacttagtgtgacatttctttggtcaggccctctattgtagattctctagttcaggtgactcagctcatttatattatgcgactaacaagaatgccagaattaagtcaactactgaatcattttcccttgcttgtttagctctgaaagctcctttatcctttttagtgaagcttgccctgtggcagcactaccttgttcacaaggatctctaccttcacctgctctgctcctgtgtaatacagctttgatcctgaagagttctgagttctccactaggatgtctagtagagcattggaacaaatttcaattaggtgagcttaagaaaaataaattgacatttttatgtaatactgtttggcctcattatgatttggaatatcaagataaatggccacctaatggaaccacagcctttaatattatacatcaacttgatttgttttgcaagtgggagagaaaatgaggtaaaataccatatgttcaagcatttttattgcttagtcaggatgaaactttacagcaagcgtgtgcatgtttaatgaaaggaaggaaagaaaaggaattagatatactagatgaccctttaatgcaagtcccctgagtccaatgggtgcctttgggtggaacagtacctccctgtgtcagctctaatgcttcaggtgcatctccctctgtctcttctagcccttctagtagtcctgtttagacactttcattcccttctccttacccgtctagtctaattttatacctacctcattctgagaggcccagtcctattctgtaactgtcactccctgaggaggccagccttgctagtactacccagagtggagcctcttctcagtctccaaaggaaaatctttgttggcttagagaagtggcaaatggggaagagcgcactataaggtccctttccccatgttttttttttggtcttatgtaaaggttatttctctgaagacccaggaaaatgtatagataaatttgagaagctaatgctgacttataatttgacctggtaggattttcatattttgttatccacatgttgtacagtggaagaaaaacaatgaattttgggattagctagaatacattcagacaaagtactagcctgcaatcctaatgatatctatagaacaaggggtatttcagtgcctgattaagatctaggattgaactatcaaagaaataggagggcttacagaagagagatcatatgattacttggttattaaaagagaggagagatgtgtgaaaaagtctcttaattattataaggtgaaagaaattactcaaggtaaagatgagaatccagcattatttcagggaaatttggttgaggcaattagaaaatatactaaaattgatcccatttcaatggaaggacaaaccttactggggctgtattttataacccagtctgccactgatgtctgtcagaaactacaaaaagcagcctgggtctgcagacatctatgaatcaacttttcagtatggcatttatggttcttaataacagatacatggcagaggaagtgaaaaacttaagagagcctcctaaaaggcacagtttttagctgcagcattaagcttaccaaccacgtgagatcatccttacacttcttagccatggcaaaggaagctggaaggcagaaagccacaagctggggttctaagcactgcaccttgggtgtaaatcaatgtgctcactgtcataaaattggctattgaaagagggaacacccagcactccaaagtgagtctttggcccctgaacaaatgatggcagttcaagagtgacagggccctagagcttctgtcacagctcccattggacaattagccatatctccagaggagcttcgggtaatcattgatgtgacaggtaacaatattaatttccttttggacatgggtgcttcttactctgttttgactcatcataatgggccattatcatcccaagactctgtggtcatggggataaacggacgagctcatagactccattttccctatcctccaagctgctcttcagggactcttgttttttcgcatgcttttcttataatgcctgaatgtcctactccattttcaggaagagatttatgaactcagctgcaaactctggttttcttcagagatcacaaggcagatgattgattgcttttacttgtctcccatgataagggaagaaaaattaataggagacactctcataatatcttgctatctttacttataccctctttgcagaaagttgaaatttaaaaagggaaaagtaactaggcattcactagaattaggttaactaaaaatttctctgcagagctccttactaggcataggaactacagcaagcatcctgaaggagtctcattagagtgtcttttagacaattgctccaaatatgtccacatagtaaagaaaagatgacacagaacaacatacacaatcaagtatacaaccactacttggtagcattaggggaagttccatggatagatgcttgtaggagctataaaaagaagtggttttggaaggaatcaaaatgagacaaagaccttaaaactaggaaaaaaatgtatctacagagttcagggaatttctgctataaaaattaattgtaacaataaattgtaaaaaaaatgacaagaaaagccaaattgtaatgaaagtgatctgcctaggttacagcagaggcaatcaataaattattctgatgttctcacaatgcagaatatgaagaatgtttgcagaaatcaatacctgttgaagattaactaatgaaaaccaaatgaagaaataaccaactatatacaatatacaatagtatacaactatatacaatatacaatagtttacaatagtatacaactatatactatgtataatagtaacatttgcaccaaaggattatagatatagaaaataaatcaaaatgatgttttataataaacatagttcaaatgtccagagatgaaaaatagttcatataatatatgtatggaaaatgacgagaaccataaacataaaaagaaacacatcaattctagaaattagaaataaactcactggttacactaaaatgtaattgataacatgaaataaaatggaactgaatgaatgaacaaaagaacaaacaataacagcagtagaaagaactagtgaatctttctatttttctccctgaatcttgactcatagagccccaataggaatcacctaatactctaggaattgccactaagctgattaaaatataaaagtgttatttgttaaaaaagaaaaaaaagctgaattagtgctctcccgattgcctgctttattcccaaaactctcttatttctaattgttttactggtcttaatcattcatgctatgtttcactgaagtatttgtgaaatatttcatgtgtttatctcaattttgattttatctcaattttggtttcattctatcttgactcttgcaacctgcatgtcctcattttactttaccaatccagctccaaagacaaccttctcatagacctaggatttctcattaaatttttaccagtttatctgagcttcattgatcttgtttctctgccaattactctgagccactgtcatcatgacctaaaattttttcacaaattacaaatttaccctttataatttatctgtgtcaaggaagactctgtagacaataccagaagaaaaaaatgtgtgcagtacatgaatgaaaaacctgatgtttcctgactttttgatgattgtcattctaactggtgtgagatgatatctcattgtggttttgatttgaatttctctgatggccagtgatggtgagcattttttcatgtgttttttggctgcataaatgtcttcttttgagaagtgtctgttcatgccctttgcccactttttgatggggttgtttgtttttttcttgtaaatttgtttgagttcattgtagattctggatatgagccctttgtcagatgagtaggttgtgaaaattttctcccattttgtgggtggccagttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataatgtgtaaggaagggatccagtttcagctttctacatatggctagccagttttcccagcaccatttattaaataggatgtggagaaataggaacacttttacactgttggtgggactgtaaactagttcaaccattgtggaagtcagtgtggcgattcctcagggatctagaactagaaataccatttgacccagccatcccattactggatatatacccaaaggactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactatcgcaagaacaaaaaaccaaacaccacatattctcactcataggtgggaattgaacgatgagatcacatggacacaggaaggggaacatcacactctggggactgttgtggggtggagggaggggggagggatagcattgggagatatacctaatgctagatgacgagttagttagtgggtgcagcgcaccagcatggcacatgtatacatatgtaaccaacctgcatattgtgcacatgtaccctaaaacttaaagtataataattaataaataaaaaaatgaaaggacaagagtaggaaagtgtaaaaaaaaaaaaagaaaaacctgactgaatcataaacaaaaataggcaattagattaaaaatttagtatttgctaattaaatcaatgatagatttttatatactttggattggtaaaaattaatatcaccataggggaagaaccaactacctggccactccagtgctgtatagagtggcaatagtagaaagatacacacgggctcaacaaactctctctacttaaaactaaggtagctattactgaaatcaaaaattcaacctgctaatatgtaaattctgatcatacctttagagatcagagaagtgaccagtagtgaggctgcagacacaatgaaacaactctaatctcaccttgttatgaactgtatctgctcctgtgttgaagagcttcatttgcgtaagattttgctttttcttcatctgaattttactatgaggcaatgcacaagattttaacaacctatagatactaactgatatgatttggctgtgttcccacccaaatctcatcttgatttgtagcttttataattccatgtgttgtgggagggacctggtaggagataactgaatcataggagcagtttcctccatacttttctcatagtagtgaataagtcttatgagatctgatggttgtataaagggcaacacctcttgcttgggtcgcaatactcacttgcctgctgccatatcagtttcctccatacttttctcatagttgtgaatgagtcttttgagatctgatggttgtataaagggcaacatctcttgcttgggccgcaatactcacttgcctgctgccatatcaatttcctccatacttttctcatagttgtgaatgagtcttttgagatctgatggttgtataaagggcaacatctcttgcttgggtctcaatactcacttgcctgccatcatatcagatgtgactttgctcctccttcctttccaccatgattgtgaggtctccccagccatgtggaactgtgagtcattaaacttcgttcctttttgaattactcagtcttgagcatatctttattagcagcatgagaaagaccaatacagtaaattggtactaggccatagggcactgctataaagataccagaaaatgtggaagcaactttggaactgggtaacaggcagaggttggaacagtttggtgggctgagatgacaggaagatgtggaaaagtttggaacttccttaagacttgttgaacggctttgaccaaagtgtgataatgatatgaatgataaaatccaggttgaggtggactcagatggagttgaggaatgtgttgggaaatggagtaaaggtcaattgcgctatgcaaagagactggtggcatctagcccctggcctagagatatgtggaactttgaacttgagagagatgatatgaggtatctggtggaagaaacttctaagcagcaaaatattcaagaggtgacagagtataaaagttgggaaaatttgcagtctgaaaatgcagtagaaaagaaaaccccattttctggggagaaattcaagttggctgcagaaatttacataagtaatgaggagccaaatgctaatcatcaagaaaatggggaaagtgtttctggggcttatcagagaacttcacggtagaccctcccatcacagattgtagggaaaagaaagagagatcagactgttattgtgtctatgtagaaagggaagacataagaaattccattttgacctgtaccttgaacaattactttgctgagatgccggtaatttgtaactttgccccagccactttgcctcagccactttacctcagccactttgccccaactttgagctcacaaaagcatgtgttgtatggaatcaaggtttaatggatctagggctgtgcaggacgtgccttattaacaaaatgtttacaagcagtatgcttggtaaaagtcatcgccattctctagtctcaataaaccaggggcacaatgcactgtggaaagctgcagggtactctgcccttgaaagccaggtattgtccaaggtttctccccatgtgatagtctgaaatataacctcctgggatgagaaagacctgactgtcccccagcccgacacccgtgaagggtctgtgctgaggtgggttagtaaaagaggaaagcctctcgcagttgagatagaggaaggccactgtctcctgcctgcccctgggaactgaatatgtcggtataaaacccaattgtacagttgttcaattctgacataggagaaaaactgccctatggcagtaggtgagacattttggcagcaatgctgccttgttattctttactccactgagatgtttgggcagagagaaacataaatctggctacgtgcacatccaggcatagtacctccccttgaacttaattatgacatagattcttttgctcacatgctttttgctgacattctccttattatcaccctgctgtccgacacattcctcttgctgagataatgaaaataataatcaacaaaaactgagggaactcagagactggtgccagtgcaagtccttggtatgctgagtgctggtcccctgggcccacttttctttctctatactttgtgtactgtacagtctccaacgggcattatttttcaaaatacagaccttgtgcggtggtcattccttcctcacagtataattaagacttttacattgtatttagatgaaatggctgcattaattggtcaggcaagactatgaatagtaaaatcgtgtggaagtgacccagatgaaatcattgttcctttaaacaaggaacaggttagacaagccgttgtcaattctggtgcatgacagattggtcttaccgattttgtgggaattattgataatcactacccaaaaacaaaaatcttccatttttaaaaattgactacttggattttacctaaaattaccagacataaacttttagaaaatgctctgacggtgtttactgatggttccagcaatggaaaagtggcttacacaggccaaaagaatgagtcattgaaactcaatgtcactcagctcaaagagcagagttggttgctgttatttcagtgttacaagattttaatcagcctattaacattgtttcagattctgcatatgtagtacaagctaaaaaggatgttgagacagccctaatcaaatatagcatggatgatcacttaaaccagctgtttaatttattacaacaaactgtaagaaaaagaaatttcccattttatattactcatattagagcacatactaatttaccagggcctttaaagcaaatgaacaagctgactcgctagtatcatctgcattcataaaagcacaagaacttcatgctttgactcatgtaaatgcatcaggactaaaaaataaatttgatatcacatggaaacaggcaaaaaatattgtacaacattgcattcagtgtcaagtcctacacctgcccactcaggaggaaggacttaatcccagaagtctaagtcctaatgctttatggcaaatggatgtcacatatgtacctcatttggaaaattgtcatttgtccatgtgacagttgatacttattcacatgttgtatgggaaacctgccagaaaggagaaagtacttcccatgttaaaagacatttattatcttgttttgctctcatgggagtatcagaaaaaattaaaacggataatgggccaagatactgtagtaaagcatttcaaaacttcttaaatcagtggaaaattacacataaaacaggaatcccttatgattcccaagggcaggccataattgaaagaactaatagaacactcaaagctcaattggttaaataaaaaaaaggaaaaagagagtagaagtgtaacacttcccagatgcaacttaatctatctagcacactatactttaaattttttaaacatttatagaaatcagaccactacttctgcagaacaacattttactggtaaaaagaacagaccacatgagggaaaactgaattggtggaaagacatgaaaaataagacatgggaaataggtaagatgataacatgagggagaggttttgcttgtgtttcaccaggagaaaatcagcttcctgtttggatacccacaaggcatttaaaattctacaatgaacccatcggagatgcaaaaaaagtgcctccacagagacagaaaacctgcaatcgagcatcatctactcgccaggtgaataaaatggtgatatcagaagaacagaggaagttgccatccaccaagaaagcggagccaccgacctgggcccaactaaaaaagctgacacagttagctgaaaaaagcctgaagaacacaagggtaacacaaactccagagaatatgctgcttgcagctttaatgattgtatcaacggtggtaagtctccctatgtctgcaggagcagctgcagctaattacacttactgggcctatgtgcctttcccgcccttaattcgggcagtcgtttggatagataatcctattgaagtatatgctaataatagtgcatgagtgccaggccccacagatgaccgtggccctgcccaacctgaggaagaaggaatgatgataaacatttccattgggtatcattttcctatttgcctggggaaggcaccaggattcttaatgcctacaacccaaaattgattggtagaagtacctactgtcagtgccaccagtaaatttacttatcacatggtaagtggaatgtcacttgggtcacaaataaataatttatagcactcttcttattaaagatcattaaaatttaggcctcagggaaaaccttgccccaaggaaattcgcaaagaatcaaaagacccagaagtcttagttcaggaagaatgtgtggctgatactgcgatggtattacaaaacaataaatttggaactattatagactgggccccttgaggccaattatattatgattgtacaggccagactcactcatgttcacaggccccatctgtctggcccactaatctggcctatgatagtgatttaactgaaaggctagaccaggtttatagaaggttagaatcaccctatccatggaaatggggtgaaaagggaatttcatcacctcgaccacagttagttactcctgttactggtcccgaacatccagaattatggaagcttactgtggcctcacaccacattagaatttgatctggaaatcaagttatgggaacaagaaatcataagccatattatactattaacttaaattcctttgcaaagttgtggaaaacccccttatatgctagttgtaggtaacatagttattaaaccagattcctaaactataacctgtgaaaattacagattgtttacttgcattgattcaacttttgattggcagcaccgtattctgctagtgagggcaagagagggcgtgtggattcctgtgtccatggactgaacgtgggaggcttccccatctgtccatatgttaacagaagtattaaaaggagttctaactagatccaaacgattcatttttactttgattgcaatgattatgggccttattgcagtcgcagctactgctgtggctgctgtaattgctttacactcctgtcttcaaactgcagaatatgtcaataattggcaaaagaattcttcaaaattgtggaattctcagacccaaatagataaaaaaattggcaaaccaagttaatgatcttagacaaactgtcatttggatgggagattgacttgtgactggaatatgtcagatttttgtattaaacctcgagcctgtaatgaatctgaatatcactgggacacggttagacaccatctacaaggaagagaagataatattaccttagatatttcaaaattaaaagaacaaatttttgaggcatcaaaatcccagttaaatctggtgccagaaactgaggaaatggtgaaagctgctgatagcctcacaaatcttaaccccgtcacttgggttaaaaccattggaagttccactattgcaaattttgtattaatccttgtgggtctgttctctctgttgttagtctacaggtgtatccagcagttccagagagacagcgaccagtgagaatgggccatgatgacgatggtggttttgtcaaaaagaaaaaggggatatgtagggaaaagaaagagagatcagactgttactgtgtctatgtagaaagggaaggcataagaaattccattttgacctgtaccttgaacaattgctttgctgagatgctggtaatttgtaactttgcccagccactttgccccaacttcgagctcacaaaaacatgtgttgtgtggaatcaaggtttaagggatctagggctgtgcaggatgtgccttgttaacaaaatgtttacaagcagtatgcttggtaaaagtcatcgccattctctagtcttgataagccaggggcacaatgcactgcagaaagcgcagggacttctgccgtggaaagccatgtattttccaaggtttctccccatgtgatagtctgaaatatggcctcatgggatgagagacctgactgtcccccagcccgacacccatgaagggtctgtgctgaggtggattagtaaaagaggaacgcctcttgcaattgagatagaggaaggccactgtctcctgcctgcccctgggaactgaatgtcttggtataaaacccgattgtacatttgttcagttctgagataggagaaaaaccaccctttggtgggaggtgagacatgttggcagcaatgctgccttgttattctttactccactgagatgtttgggtggagagaaatgtaaatctggcctacgtgcacatccaggcatagtacctccccttgaacttaattgtgacatagattcttttgctcacatgtttttctgttgatcttctccttattatcaccctgctctcctactgtattcctcttgctgagataatgaaaataataatcaataaaaactgagggaactcagagactggtgccagtgcaggtccttggtatgctgagcgccagtccactgggcccacttttctttctctatactttgtctttgtgtctgatttcttttctcagtctctcatcccacctgatgagatataaccacaggtgttgaggtgctggccaccccttcacacctatggatatatcttgacaggtgggtcacacaaattgggaaaatttgcagtagaaaagaaaaccccattttctgggcagaaattcaagttgtctgcagaaatttatgtaagtaatgagaagccaaattctaatcatcaagaaaattgggaaaatgtttctggggcatatcagagaacttcacggcagaccctcccatcacaggcctggagtcctaggaaggaaaatggtttcacaggccaggcctagggccccccatgctctgggcagcttcaggacatgatgtccttcatccaagctgtttcagctccagccatggctaaaaggggccaaggtatagctcaggccattgcttcagagggtgcaagccccaagccttggtagcttttctggggtgttgagcttgcaggtgtacagaagtcaagaactgagttttgggaacctgtgcttagatttcagaggatgtatggaaatacctagatgtccaggcagaagtttcctgcatgggcgggaccctcatgcagaaactctgctagggtagtcagaagggaaatgtggggttgaagtcccaacccagtgtcgccactggggcaccacctagtagagctgtgagaagagggccaccatcctccagaccccagaatggtagattcactgatagctttcactatgtgcctagaaaagctgaagacactcaatgccagcctgtaaagtagcagggagggaggccctaccctgcaaagtcacaagtgtgaagctgcccaagaccatgggaacccactacttgcattagcgtgacctggatgtaagacattaagtcaaaggagataattttggagttttaatatttgactgcccctctggattttagattcacatgaggcatgtagcccctttgtttttgtcaagttctcccatgtggaatggctgaatttacccaatgcctgtactcccatgtattgaggaagaaactaacttgtttttgattttacaggctcataggtggaaggaacttgccttgtgtcagctgagactttggactgtggacttttgaattaatgctgaaatgaattaaggctttgggggactgttggaaaggtatgctttgttttgaaatgtgagggcatgagatttggagaggctgagggcggaatgatatggtttgtctccacccaaatctcaccttgaattgtagctcccataatttcatgtgttgtgggagggacctggtgggagataattgaatcatgggggcaattttttccatactattcttgtggtagtgaatgagtctcaatagatctgatttttttttttttttttttttttgagacggagtctcactctgtctcccaagctggagggcaatggcacgatctcggtttgctgcaacttccacctcctgggttcaagccattctcctgccccagcttcctgaacagctgggactacaggcacatgctggtacatccagctaattttttgtattttttttttagtagagatggggttttaccatattgcctgggctggtctcaaactcctgaactcaggcaatccgcacacctttgtctcccaaagtactaggattacaggtgtgagccaccacacctggcctgatctgatgattttataaaggaaacccctttcatttgggtctcaatgttctcttgcctgccaccttgtgatatgtgaatttgctccttcttgccttctgccatgattgtgaggcttccccagccatgtggaactgtgagtctgttaaacctctttcctttataaattactctgtattggatatgtctttattggcagcacgagaacagactaacacagtaacaaatgagaaatttataatattgttgtctgctataccacttttcaatttgttgaaggtggagatttttaagcagtaggaaatccttagatggttattacaaaataggatgattataatgaaaattaatgtgcttaaaataaaggttttaatacaatatcatcagaagttgggagaattaatggaacccctagaaagttcccgaaccctcagacttccaagccaatctgctccatttatcacagtttggagtagtttacaaagcacaaatgcagaaatcacaatgtgaaaatttattaacgctttcctcagataatattgagatattaatcaagataaaagtttgcaaaaaggcaagcgtctcttggctcaatcaccttgtacagacacaaaacacattaagtcctaatagagcctaagtaaaggttaatgaaatgaagataaaaggttatagaaaagttggtatatatccacaagctttatgtgaagtagttacatctcttttatctgacagtattattagaatggacattgtatctaactgggaaatgtttcccacatctagtattatacaatggaaggcatccaaatttgtctttaaatcattatgaattgggcattctaaatagaagccagtaagatattccatccaagttcatacagtgtagaatagaagctggagtgctgatagaaaaaaattctctgttcgatagccctatatcaagcataacttatagtaatatgctgtgagtatctcccagtgataaatactgggatttgggaaaggagaatttccacttgagtggcatttactaccttgctgtagtacattaattgaagctatccataacagttcatcaaataaccttgaaacatgaaatacccatgatgtcttgcataatgtaaatgaaacactccagtcatatagcagtacccagaagagttttgtactacaatggaaattgtctatatagaatcaaactgcgtcatgaatgcctgaaggagatattcttaagctcagaacccctttcctcctaggactgattctgaaactgtgtgaggagttgcctaattccacagtgctctataaatagctcacaactgactgacaaagatctgctaggcttgtagatggcacttacagggtgaatgaacaaactactgccatattgattctttttttctagttcttatgtaaatcctttttaaaaaaagggtttttttttttttttttttttttttttggaatggtctcactctgttggccaggctgaagagcatacaattacagtttactgcagcctcagcctcaaactcccaggctcagatgattcaccaacttcagtcccccaagtagctgggactacaggcatacatggccatgcctgacatttttaaaaagctttatttgtaggtatagggtctcactataatgccctggctggtgttgaactcctaggcttaagtccttctctcaccttagcctcctagaatgccaagattataggtgtgagctgctgctgtatctggtctgtaaatccttttttctgtcttcatcatttattggcttccttggaattaagggattatcttgttgtatgtttttatttcttcctttttatttttagggtatttattataggtgttctgtgcttatcataaggcttacatgaaaacaccttcttttttattatactttaagttctagggtacatgtgcacaacatacaggtttgatacataggtgtacatgggccatgttggcttgctgcccccatcaactcatcacttacattaggaatttctcctaatgttatatccctcctccagccacccacccccaacaggccccagtgtgtggtcctctgccctgtgtccaagtgatctcattgttcaattcccacctatgagtgagaacatgcattgtttggttttctgtccttgtgacagtttgctgagaatgatggtttccagcttcatccatgtccctgcaaaggatatgaactcatcattttttatggctgcataatattccatgctgtatatgtgccacattttcttaatccagtctatcattgatggacatttgggttggttccaagtctttgctattgtgaatagtgctgcagtaaacatacgtgtgcatgtgtctttatagtagcatgatttaaaatcctttggatatgtacccagtaaagggatcgctgggtcaaatggtatttctagttctagatccttgaggaatcgccacacagtgctccacaaaggttgaactaatttacactcccaccaacagtgtaaaagcgttcctatttttccacaccctctccagcatctgttgtttcttgtctttttaatgattgccgttctaactggtgtgagatggtatcttattgtggttttggtttgcatttctctgatgaccagtgatgatgatcattttttcgtgtatctgttggctgcatagatgtcttcttttgagaattgtctgttcgtatccttcacccactttttgatggggttgcttgtttttttcttgtaaatttgtttgagttctttgtagattctggatattagccctatgtcagatgcgtagattgcaaaatttttctcccattctgtaggttgcctattcactctgatggtagtttcttttgtcatgcgcaaaagctttttgtttaatttgatcccatttgtcaattttggcttttgttgccattgctttttgtgttttagtcatgaagtccttgctcatgcctacatcctgaatggtattgcctaggttttcttaaagggtttttatggttttaggtctaacatttaagtctttaatccatcttgaattaatttatgtgaaaagtgtaaggaagggatccagtttcagctttctacatatgtctagccaattttcgcaccaccatttattaaatagggaatcctttccccattgcttgtttttgtcaggtttgtcaaaaatcagatggttgtagatgtgtcgtgttatttctgatgtctctgttgtgttccattggtctacatctctgctttggtatcagtactatgctattttggttactgtagccttatagtatagtttgaagtcaggtagcaagatgcctccagctttgttatttttgcttaggattgtcttggctgtgtgggctcttttttggttctatatgaattttaaaatagtttttttccaattctgtgaagaaagtcattggtagcttgatgggaataccatcaaatctataaattaccttgggcagcatggccattttcatgatatttattctttctatccatgagcatggaatgttcttccatttgtttgtatcctcttttatttcattgagcagtggtttgtagttctccttgaagaggtccttcacatcccttgtaagttggattcctaggtattttattctcttagcagcaattgtgaatgggagttcactcatgatttggctctctgttggtctgttattgatgtttaaaaatgcttgtgatttttgcacgtccattttgtatcctgaaactttgctgaagttgcttatcagcttaaggagattttgggctgaaaagatgggtttttctaaatataaaatcatgccatctgcaaacagagacaatttgacttcctcttttcctaattgaatactctttatttctttctcttgcctgatcaccctggccagaacttccaacactatgctgaataggagtggtgagagagggcattcctatcttgtgctggttttcagagggaattcttccagtttttgcccattcagtatgatattggctgtgggtttgtcataaatagctcttagtattttgagatacgttccatcaatacctcgtttattgagagttttagcatgaagagttgttgaatttcattgaaggtcttttctgcatttattgagataatcaagtggtttttcattggttctgtttatgttatggattatatttatttatttgcatatgttggaccagccttgcctcccagctgacttaatcatggtggataagctttttgatgtgctgctggattcggtttgccagtattttattgaggatgttcgcattgatgttcttcagggatattggtctaaaactctgtttttttgttgtgactctgccaggctttggtatcaggatgatgttggcctcataaaattagttagggaggattccctccttttctattgattggaatagttttagaaggaatggtaccagctcctctttgtatctctggtgaaattcagctgtgaatccatctggtcctggactttttttcattggtagcctattaattattgcctcaatttcagagtctgtttctggtctatgcagagattcaacttcttcctggtttagtcttgggagggtgtatgtgtccaggaatttatccatttcttctagattttctagtttatttgcgtagaggtatttatagtattctctgttggtagtttgtatatctgtgggatcagtggaggtatcccctttatcattttctattgagtctatttgattcttctctcttttcttttttattattcttgctagtggtctatcaattttgtcgatcatttcaagaagccagctcctggattcattgattttttggaggtttttttttgtctctatctctttcagttctgccctgatcatagttatttcttgccttctgctagcttttgaatttgtttgctcttgcttctctagttcttttaattgtgatgttagggtgtcaattttagatatttcctgctttcttttgtgggcatttagtgccataaatttccctctacacactgctttaaatgtgtcctagagattctggtacattatgtctttgttctcattggcttcaaagacatatttatttctgccttcgtttccttatttgcccagtagtcatgcaggagcaggttgttcagtttccatgtagttgtgcagttttgagtgagtttcttaattctgagttctaatttgattgcactgtggtctgagagacagtttgttgtgatttctgttcttttacatttgctgaggagtgctttacttccaattatgtggtcaattttagaataagtgggatgtggtgctgagaagaatgtatattctgttgatttggggttgaaagttttgtaaatgtctattaggtcttaaacttaaagtataatttaaaaaaagaaagtaaaaagatgataatccacttcatgaaaacacacaaaattatataactcactcatagagccaacagacaaaggagaaagaaaaaagaatcaaactttatcagtatagaaaactaccaaactgtcaaaaataagtaataagagagaaattaaggaataagggttatacaaaataaacagaaaaaataaaagaataagcctttacctataaatacataaataaataccttgaaaataggtggattaaattatacaactcaaaacatagactaatggattaaaaaacaagacccaactatatacagcctaaaagaaactcatctcacctataaagttacacatagactgcaattgaaaagatgaaatagatatgctatgcaaacagaaacccaaatcaagcagaaatagcttcacttacataagcaaaacacaaactttaagccaaaactttaaggagaggaaaagagagacttaatatgataataaatgaatcaattgttcaaaaagacaaaaatgtaaatatatatgcaaacaaccatgaaccattgagatatatgaagcaaatattattatacctgaaaggagagatggacctaagttcaataatatttgaggatgtcaccaccaccttttcagcattggacagatatttagacaaaaaatcaatagaaacacatgagatttatactgtaccatagaccaaatcgaagtaattgacatttacagaacattttatccaacagctgcagaatataagattctttttatagcacatataacatccccagaattaaccatatatgaggacattaagcaagtctcaacaaattttaaaaaataaaaattttactaattattttatctgaacacaatgaaataaagtataaaatcaatgacaagacaaaactagaaaaatccatgaaaatttaacaacgtattccttataaccaataggtaaaaaaagaaacaattttaaaattacttaaaacaagaaaaattacatcatgcgatagcaaaatgtatgagattcaacagaagcactattaagagacaagtttagaacaagaaatgcctacatgaaagaagtagaaaagtttcaaataaacaacctaatgatctctctcaaagaactctaaaaataggaacaaaccaaaaccaaaattagtgtaagtaaagaaatactaaaaattagagagaaaaaatgaaattaagactaaaaaagatgaaacaaaatgctaacttttttaaaagacaaaatcagcaaggcattgactagactaataaagaaaaacaagaaaatatccaatttaataaaatcaaaaacagaacaggaaacttcacaactgatacagaaatacagcacatcattaaagattgtaatcagcaactacacaacaaatttgaaaacctggaagaaatggatacatttcttgacatatacattagactaagataaaaacaacaaaaaatataaatcttgcacagactaatactgaataacaacattaaatcagtaacaaaaagccctccaataaataaaagtccaggactacctggagtcacaactgtattctaccaactttaaattattatgctaactacagaaaccagttacaaaaaacacatcttgtgtgattccatttatatgaagccctcaaaattggaaaatgtatagagacagaaagtagattagaggttgtccagggttgagggataaggagatgctaaggatacgaggttagttaaggatgatgaaataatgtaaaattgaacatcacgatagtcacacaaattctgtgaaaatacaatgagccactgaattgtcttggctttaaattagtaaactgtattatatgtcaaatatatgtcaacaaaacttttacaaaacaaataaacaaacatcccttggaccatgatatctaagaaagtctgattcagctgtgtaagtactttaggcctacgccaagcagactgcagacacaaagcacctcttgctatccactgttcataacatgattctaaactttcttatatcacataggtgatttgtatttgcaagataatcagaacttaaatggggaaaagcatttgtaattgttaaaagagatattaaacacatcatataacacaaggtcatctagatttcactttttccacttgccatgaagatactctgaccattcaaataatgtacttacattgatatgtagtagttatattttaaattcttgacaatctcttctttaatataagcaagataaatggtacagggataaaatttgaaaggaagtaccgcatttaatcaggatgtctatgaaatgaatttcagctctactatagctactgctgagttttttcctcaactctggaagtcgtgaaaaggtgctgatgtagctatggaatacagtcattggatcgatttagaggcaaaactggatgaacttatccagatgaatcatgagatcattgtgagaccatcggcttccatttttcttgatctcagcaaaccatttgctattaccttggaatttaattctatatctttattgaaagaaaacttaaaggattattgtctcagttaataaatataattggtggaaagatatattttagacatttatttcattcatcaaaaaatattttgcaaatattttgtttattttaaaagctctgtcagatgttgttttacaaatagaaaagtatcgcaggcttatggattggaaaaataaatattgtgaaaatgaccatactgcccaaagcaatctacagattcaatgcaatttctattgaattatcaatgtcatttataagataattataaaatataattctaaagtttatatggaaccaaaaaaagaacccagattacaaaggaaatcctgagcaaaaggaacaaagctgatggcataacattacctatcttcaacatatactacaaaactgtagtaaccaaaacagcaaagtactggtataaaagtagacacatagaccaacagaacagaatagagaacccagaaataaagccaaatacttaaaaccaactgttcaacaaagcagacacaaacatgcacaaaggaaaggacactctattcaaaaaattgtgatagaaaaaaaggagagccacatgcagaagcgtgaaactggatgactatctctcatcatatgcaaaaattaactgaaggtggattaaagacttaaatgcagaagaaaatataagaaatactcttttggacattgacctacacaaagaatttatgactaaagacacaaaaagaaaagcaacaaaaccaaaataaagaaatgggactttaaaaagcttctgcacagcaaaagaaataatcaatagagtaaacagacaacgtacagaatgggagaaaatatttacaaactctatatctgacagaggattactaatcagaatcaacaagtaactcaaacaaatcagcaagaagaaacaatcttataaaaaatgggcaaatgacatgaatagacatttctcaaaagaagatatacaaatggtcagcaaatatggaaaaaagctgaacatcagtaaccatcagggaaatgcaaattaaaaccacaatgagatatcacctgactaatggtatactcttatcagaatgattgtattttaaaagtcaaaaaaagtagatattggcgcagatgtggtgaaatgggaacatttaaacactgttggtgggaacataaactagtacaacctctgtgaaaaactgcatggagatttctcaaataactaaaagtaggtaaaatatttgatccagtaatcttactaccagttacctacacaaaggaaaggaagtcattatattaaaaagacatctgcactcatatgtttattgcaacaaacttcacaattccaaagatatggaatcaacctaagtgcccatcgacagatgagtgaataaagaaaatgtgatctatatatcacatggatatacacggccacatctcacaggaaaaattccagatcatccatgggaacttccccttacctcagcgcctttggggactttgaccaaaactaggaaggctgcatcagtagggaaaagatgctttccttttcctgtgcttcagctccttgctgggagtctacatgggttttgtacacagtttccaggagggcaactcctagagtgcagtagcctgctgccactgcgaagccctgatcctgggcatctataagcagggcctcaactgccaagccagtggtatgagctgccaccagcagtgcaaggattgcctgtaagttgagcaccagtgcaggccccagagtgtgggcctggaggagtctccacgtcaccctcacacactcatacccaccatcatcccaccttcagcttctccctgccctgccatggcaaacgagactcccagcctccagagattcatgaggaggagatgcagatggtgaaggatggggtgtttgacaactgcttgtaattgatgctatgattggatcaaggactcattcctgccttggagaaaagacttgaaccagagcagggagcctgggggtgctgggacagaaggttggggctgagggcagaatgtgatggtggcatgcagctaagggcagggccagggcaggcgtccctaaggttgtaccaacttttgtgaatatttgtattttcctcatggaataaaaaggctcatgtaattaatctccatatatatatacatttatatatgtgtatatatacatttatatatatataaatgtatacacacacacacacacacacacagaaagagagtagtatatacatacacagcatacatgcatatatattcccttttttctgggagtttttccactcatttccattcaccaaagcaatgcctttgtgccatgtacgtgaagaaatattcgtctgctctagcaaagacctcatctggcacagaagctgtcagggaaacaactacttggttgaatttgcaggagggaaaaggggagacttctttgagatccctggtttttttaatgaagactttatatggcttaccctgtgagaaatgttaaatttctggacaatccttggctaaccagatctgtatattagtacgttccaagttgttcagcagaacagcagacaaattacttttatttttaatttcaatactctttgctttagaaacaattttgctgtggcacttcctagtctgtgactctgtcttgaaaagggctggaactcaggctgcgtagacatacatatttcatttatctggtcttcaacttaaacattcacctctttataaaaacttctctgtaattctgaaggtaattcccctttttttgatggagttcaaaaattgctgacttgcactgttgggaaatcatcactgactgtgatttcattttccatactttcatatttacatccacctgctttttctgttcagtgggagacaagcagttggagccaaccttctgagcttcttcaaaaaggctatcaacaaaatattcacaatttgttgattatcactgagagattgattgtcagatactgtttcacaaacccatcttcttttatactttcgagattatctacctctttcattctcttttgtcttattctgggcagggtctcctggcctcagcctcactcagctcagaggccacgagcaccctttggccccgggctccgtctggagcccgctgctccagacctccttaggttccgccgcggcacagctaggatcctgacggactctctaggtctctgccaggcaccagacaccaaaagcatgctgatgtagtctcaattgatttgtttttaaattggtaattaaacctccacctttattgaaagatcatttggaagattttgttctcatactcggtcagttaataaacatatgatttgtcaaaagatagattttagaaacattttatgaattcaaaaaatttgagggaaatatttgggttgttttagaagctctgtcaagatgtagttttaatcaagaaacttatgtcaaaagtttaagaatcaagccttaatattattcttgcagatgtccttggtaaaatctgctggtggggataattaaaatacacattgtatatactttgtatttcctttttggccttttttttttttttaatggagtctaactgtcacccaggctggagtgctagagtgcagtggcacaatcttggctcaccacaacctctgccttccagatggaagcaattctcgtgcctcagcctcctgagtagctgggactacaggtgtgccccaccacgcctggctaatttttttgtatttttattaaagatggggtttcaccatgttggccaggctggtcttgaactcctgacctcaggtgatctctctaccttggcctcccaaagtgctgggattacaggtatgagcccctgtgcccagcccagtgtggagcttctattcactcctttctatgtacctgtggttctgtcagaattaagtgatcaaataacataaatggagatggtaaaaaaatgtgataagacatcagaaagatagtgggatagaaagccagcaactcatgtctccccttgcaacaataagaatttttcacacaaccacagataaaagactctttagttttggtattcaggtaggatgttgtgaaacccctgtgtagcccaagacctagcaagggcattttgagaatacataacagaactcaggtattagactcacttataatgccagaaacagccccatttcccaaaaagcttgtctacagccctgtttggccttgagcctgtaatcaaaattatcttcccaggagtccaggaggaatcatactcactagtgccttagcagaaaagcttatctgtccaccaacattggtctcagcagcagaattgacagttatcctgtaactcaggggaaaccccttcagttgtggtgccagattattactgcttgggcaaggacatagaagcagatttacccatgtctttcagtccagtaattacctgttcatctgagtgtgtgacaggcctgtcaatcttcattcaaacacaaattatgaggaagcctagtttcagctctagcccttctggctgcagttggagaactatcctacccacataggaaagtgctgggggttgcttgtccacctgctaatgaggtcggctcaccatcctccttctgcagtaagtccctagggagcccagccccagctccaaccttcctttctgcagtcagggaccttccctgctcgtgcagaaaactattgggaagcacatttgcctgggccaccatccaggctcaccagtctctgctcccagagcatattctgggagtgggaagggcagtctcgactcaaacccctcttgctacattcaaagaactgcttctacttttcaagaaagacaaaagagacaagagacaaaagagcagaaggctattcaaagaaataatagcggaaaactttcataacttggagaagatataaacatccaggtagagttaggtaaaattaaccgataagatacaacataaataagattactctaatatatattataatcaaactctcaaaagtcaaagacaagctgctgaaagcagcaagataaaagaagtaaaatgcatgtaaaggaattacaagacatctggcaacagacttctctggagaaaccttgtcagccatgatagtgtcagacaatacattcagagtacctaaggcaaaacaaaacaaaacaaaacaaaacaaaacaaaacaaaacctgccaatcaaaaatactgcatccagtattagaaatgctatcctttagaaatgaagtagagataaagactttccagacagactgagtaaatctagcatcaccagacatgtcctacaagaaatacaaaaatgagttattcaaactgaaggaaaaagatgtttttgcataacaagaaatcatctgaagacagaaacttcactggaaaatgtaagtaggaaggcaaattcagaatactctaatactgtaattgtagtgtgtaaaccacttacatcttcagtataaatactaaaagacaaaacaataaaaagtaataataactacaaaaatttattaagagattggaaatataaaaaatgtaaattgtggcatcgaaaacttaaaatacaagggaatattacagttaaagtatacaggggttttttttgcttctctttcaaatcaaagataattgtattggtttaaaataactttttataagatatttttctctccattccaagatggctgaacaggaacagccccggtctgcaactcacagcatgatggatgcagaagataggtgatttctgcatttccaatggaggtacctcgttaatctctttgggactggatggacagtgggtgcagcccacggagggtgagctgaagtgtaaggggtcagggtgtttccctttcctagcaagggaagctgtgacagactgtacctggaaaaatggggcactcctgcccaaatattgcacttttcccagggtcttagcaactggcagacaaggagattctctcccgtgcctgacttgggggggtcccatgcccatggagccttgctctctgctagcacagcagtctgagatcaaattgtgaggcaacagcctggctgcaggaggggtatccatcattgctgaggcttgagtaggtaaacaaagcagccgagaagcttgaactgggtggagtgcatggaagttcagcaagccctactgcctctagactccacctctgtggacaggacatagctgaacaaaaggcagcagacaacttctgcagacttaaacgtccctgtctgagagctctggagagagcagtagttctcccagcacggagtttgagctctgagaacagacagactgccttctcaagtgggtccctgatccctgtgtagcctaactgagagacatctcccagtaggggccaacagacacctcatgtaggtgggtgtgcctctggtacgaagcttctagacgaaggatcgggcagcaatatttgccgttctgcaatatttgctgttctgcagcctccactggtgatacccaggcaaacggggtctggagtggacctccagcaaactccaacaaacctgcagctgagggacctgtctgttagaaggaaagccaacaaacagaaaggaatagcatcaacatcaacaaagaggacctccacaccaaaaccccatctgtaggtcaccaacatcaaagaccaaaggtagataaaaccacaaagatggggaaaaaccagagcagaaaagctgaaaattctaaaaatcagaatgctacttctcctcaaaagtatcacagctcctcaccagcaacagaacaaagctggacagagaatgactttgacgagttgatagaagtaggcttcagaaggtcgttaataacaaacttctctaagctaaaggagcatgttcaaacccattgcaaggaagctaaaaaccttgaaaaaaaggttagacaaatggatagttagaataaacagtgtagagaagaccttaaatgacctgatggagctgaaaaccatggcacgagaacttcgtgatgcatgcacaaggttcaatagctgaatcaatcaagtggaagaaagggtatcaatgactgaagatcaaatttatgaaataattgtgagaagacaaggtaagagaaaaaagaagaaaaagaaatgaacaaagcctgcaagaaatacaggattgtgtgaagaggccaaatatacattagattggtgtacctgaaagtgatagggagaatggaaccaagttggaaaacactcttcagtttattatccaggagaacttccccaacctagcaaggcaggccaacattcaaattcaagaagtacagagaacaccataaagataatcctcgagaagagcaaacccaaggcacataattgtcaggttcaccaaggttgaaatgcaggaaaaaatgttaagggcagccagagagaaagatcgggttacccacaaagggaagcccatcagactaacagcagctctctcagcagaaactctacaagccagaagagggtgggggtcaatattcaacattcttaaagaaaagaattttcaacccagaatttcatatccagccaaactaagcttcataagtgaaggagaaataaaatcctttacagacaagcaaatactgagagatcttgtcaccaccagaactgccttaaaagagctcctgaaggaagcactaaatatggaaaggaacaactggtactagccactgcaaaaacatgccaaattgtaaagaccattgatgttaggaagaaactgcatcaactaacaggcaaaataaccagctaacatcacaatgacaggatcaaattcacacataacaatattaaccttaaaggtaaattggctaaatgccccagttaaaagacaaagaccggcaaattgaatagagtccagacccatcagtgtgctatattcaggagacccatctcacgtgcagagacacacataggctcaaataaagggttggaggaagatctaacaaccaaacggaaaacaaaaaaaagcaggggttgtaatcctagtctctgataaaacagactttaaatcaacaaagatcaggagacaaagaaagccattacataatgataaagggatcaattcaacaagaagagataactattctaaatatatatgcactgaatacaggagcacccagattcataaggcaagtccttggagacctacaaagagacttaggctcccacacgatagtaaagggagactttaacaccccactgtcaatattagacacatccatgaaacagaaggttaacaaggatatccaggacttgaactcagctctgcaacgagcagacctaatagacatctacagaactctccacccaaaagtcaacagaatatgcattcttcttggaaccacatcacacttgttccaaaactgaccacatagttggaagtaaagccctccacaacaaatgtaaaagaacagaaataacaacaaactgtctctcagaccacagtacactgaaattagaactcaggattaagaaactcactcaaaaccacacaactacatggaaactcaacaacctgctcctgcatgactactgtgtaaataacaaaatgcaggcagaagtaaagatgttctttgacaccaatgagaacaaagacacaatataccataatctctgggacacctttaaagcagtgtgtagaaggaaatttatagtactaaatgcccacaaaagaaagcaagaaaaatctaaaatcaacaccctaacatcacaattaaaagaactagagaagcaagagtaaacacattcaaaagctagcagaaggcaagcaatacctaagattagaacagaactgaaggagatagagacacacaaaaaaacccttcaaaaaaatcaatgaatccaggagctggttttttgaaaagatcaacagcaagtattgtagaacagcaaacattgctgcctgatccttcctctggaagcttcatctcagaggggcacctggctgcatgaggtgtcagttggcccctactcagaagtgtctcccagttaggctacccaggggccagagacccacttgaggaggcagtctgtccatttcagagctcaaacaccatggtgggagaaccactgctctcttcagagctgtcagacagggatgtttaagtctgcagaagcttctgctgccttttgttcagctatgccctgccagcaaaggtggagtctacagaggtaggcaggcctccttgagctgtggtgggctccacccagttcaagcgtcctggctgctttgtttacctactcaagcctcagcaatggcgaatgcccctcccccagccagtctgcctccttgcagttggatcttggactgctgtgctagcagtgagcaaggctccatgggcatgggacccactgagccaggcatgggatgtaatctcctgggtgtgtcatttgctgagaccattggaaaagtgcagtattaaggtgggagtgtcctgattttcctggtagagtctgtcatggcttcccctggctaggaaagggaaatcccccaaccccttgcacctccggggtgaggcgatgccccgcccagcttcagcctgccttccgtgggctgcacccactgtccaaccagtcccagtgagatgaaccaggtacctcagttgaaaatgcagaaatcacccatcttctgcattgatcatgctgggagctgcagaccagagccgttcctgttcagccatcttggttcatcactatagacacgttacaaaggaagatatacaagcagccaacaagcatatgaacaaaaaggtcaatatcactgatcattagggaaatgcaaattgtaaccacagtgagataccactgatcattagataaatgcaaatcaaaaccacagtgagatactatttcacacaagtaagagtggctataattagtcaaaaaatagcagatactggtgaggttgcagagcaaagggaacatttatacactgttggtggaagtataaattagttcaaccattgtggaaagaggtgtggtgattactcaaaaagctaaaagcagaactaccatttgacccagcagtcctattactggatatatgcccaaaggaatatgtatcattctaccataaagacacatgtacatttatgttcattgcagcactgttcacaataggaaagatatggaatcacctaaatgcccatcagtggtagactggataaagaatatatggtacatatacaccatggaatactatgcagccataaaaaagactgagatcatgtactttgcaggcacatggatggagctggagaccatcatccttagcaaactaacacaggaacagaaaaccaaatgctgcatgtactcacttatgaggaggagctaactgatgagaacacatggatgcaaagagacaacagacactggggtctacttgagggtggagggttggggagaagaataggatcagaaaaaataactattgggtcctaggctttgtacctgggtgatgaagtagtctgcacagcaaactcccgtgacaggagatcagctatattagaagcctgcacttttacccctgaacctaaactataagttaaaaaaaaaaaacttaataaagaaacgtaaagtcaaaagttttgtgactattatgtcaaaattatgtgcttatcattttgctgctattccttttttaaaaaatgcatttttttctctctctgtaaaataatggtgttccctttccaatgcaaacatactttcagatcctaatcattggggtaaacattctttttaaaactactgtttacaaaagtaaaaatctgactttgtccatgcagatcatctattgacaagtatttttcaacagcataattttaaccttaagacatcagttttaatagcagtcattacattattattccaggtgattcatgggacacctgagcactctgtataattgaagttatctgtagccacatttaatatgacatgttcaatgtttggtctcacaagctcactgcttagagtcttcttcatccacccaatattgaagtaatgaaatggctgttaatagattcatcactgatctcattctgtgacatctttatcagaataatataaaatcaatgtaagaaattttgtgaaattatgaaaatttagaaaaaaataaatttcatttataaaatctgtgtgctttcattatggttttattctatttatataactcaatgtacatatattatgtttatataaaatctttttatctcattgcatatgtcttttcttccgacacaaaaattgtgatatttttctgttcatcattatgttgcatagtattcaacaatacctgtactatggctgacagtgtaatttaacattttttgataaaacaattgtaatggcatggtacacacattgtatacattttaaatcatttctcaatgtaaaatatttgaattgtctccagtgtttattttatgaatgtctgccacaaatattgaatctgaccatcgtgatttagttgttctctgtatagtttcatatgagtatattatgaagccaatgtctatgtgcatttttataatacttaatacttttccccaagtgtctgattcttttaaaatatgcaaacattatctgagaatctaatgcataatggaaaagcaagcaaatttgtgacaacaattattttatgtaagaaggaattagaggacaggctgcacaactattgacttggattggaacctaccttctgcaaatgaataacaacagctagtattagtatttatcaccattgtactaatagtcattcttgcccttgtcttccttctccacctactctcttcccccttctaatggcaccatcactttcctctattgcgaaaggggaaattttttgagaataaggttagagtgcatagaattttcattggtcctacctctgcctttgtcctttgggaaattaccacatagagcctatgcaattttcattcagcataaacattgggatttaactcgactaagatttcagttttctgttgttgctaataagaaggtagacaaaaagatctcttaagacttatataataaagtagtgaggaatgcttgctttctacttatgtctcaaaagaataacattaaagtaaaatatatgaggttcttttgtttcttcataaggaagatcatcctatatcctggcataattctttgataaatctcagtgtagttttcagatgcaagtggtagacattatttggatcttattatacatgcattgttcattttttttttggtgcttctctgtcaggcagctgtgatgatgagtcccaagtttcccagagatttttactgaggtgtcctataggcgtggcataaggcagaaaacattaaaagggtaaactgacccttttatgctctaagatataaacctctgtgatctcactgacgaaagttttaaatgctagagtgaaagcaagtaaacattggctttggctgagaatattctggtggcacacatttatgtcgttgatgaatagtgtaccttgaaaagccttaacccttacatcgttagcatttcatcttgttcatctgactgcccaaaaatctatatttaaacaagtccacaggggatctgttctctaggactttgctggagaaccttgatgtgttggaaaactgttcctattaatagaaaaattatatctcgagtggctggcatatgttaactaatggatactattaatagtaataacaaaaataaaaaatcattacaatattactactatttgaatcactatgtacgagagacattataagtgttttatctgtattaagtatattttcaacacaacacaataggaagaaattgccattattatagaagtaggcataattatctctatcaacattctagtccacttttccattatctgttgcataaactcatgcaaaatcttctaaatgatctacacttttcacaatctggcctttttgtgatgtaatccattgacaacattgagagctttttaaagaaagggaatctgatcacatctctccatttcttaactctgtgcagtagctccccattgcccttaatagacacttcgatctccttataattatattgcttccacttacctctctagcaacatctgctactttactcagctttttcctgcatactaattagaaatcttaggaactgcctttacttcactacctgcttttctttttttgttttcctctccccctcttcttttcacctattcctgcacattactgaggactcactttaccaatgactttgagatctcttctagatgtttgcttagcattgtgaccttataacacttttagacttttcctttttacttgcttatagtctatctttcaaagtacaacgtaaggcatgagggagcagaaagtgcctacatttcttctctgaaaatcgagcacttatccatggtttatgctgatcacttcataaacattctttgaaggaatgacttatactttttttttactttgcacaatgaaggctttcattgaatcaaccctgttttcagagtctctttagtatccctctttgatatttaatgacactaaagtttacacagttgtgatgatatagaaacatatgagtttctaatggtaggtcgctttactcgacctcccatattttctcttactgtgagtcaaacactctgaataaaaacatatctggccattccttctgaaatgcaaagcaaacaaatcaaacaggagtaaatttaccttaggcagggttttggctggtttacagtggagttcccccacaaaatcgacatttggtaagggtgggtgaagaaattcaaaatcccagtacagttgaatgagccacacttcagctttccccattgtctgaaataatgtacattaataaaataaatgtatacatatctttttatacataagcataacaattttcatatattgcatgttacttatatataaggaaagcaaagtgttcagataattaagaggaaattacatatttaatgtaacataagtatattcacaatcacaaatagttattgaaataagccactatggacttaaatatgcatttgtttcctctctaaagttgcagtagtaaccaatatagatttaaacagctctttgagctccacgattaattcatcttactatacttataaaaacagctttctacaaagcacaaaatctagtttccacaatttatcaagtcagtcccttgatccttggttctccaagtgaactgtgagttttctgagagtatggctgaaatccttgaacatactactgcttctagttcatgttaagattttaatgatattagttgtaaaatacatacatttaaaaatgatagctagtatatattcagaatttattgaaacagagatatgtgctcccccttaacttggcccatattttccctaataaagagaagtagttcaataaaatatagattaaaagcttgaatgttcactttcaacaaggtttcagttcacaaagcaaataatttccaagttgttagtgaactatgaacaaacactagaaacctcaaattttaggtttctgtttctgaaatagagccagtatacctctcaactgtgaaggaatccttctgtttatagagaaaaatattttaatacctaaataagaaaactgaggtacacaaagagaaacaagtttctcaatgctgcattaatagttatgctagaaatatgtgtagctcctcatctaaatgtctgccttcatcaagttgtttattgatatatgtattgccttttttaaagatgaaaaaagtatagtaaaatacttatatagttgcttaaagaaatcataagtgctttactttgtagttttttttttttaattcctgtagtgtcctataggagcgatggccaaagggttctagctgagcctataatatcaacatttctataatatttgtgagattgatagatcatcttacatttgccattcatcatttcatttaaacaacactatcttcttacattatatttatatacgctcaccttcaaaggcaaaaggaaagttagaacttattaaccattgattagaaacatgacttacctagaacttcactgtaaaacttctcccacttctcgtatcaaacatttgaaaccaaaagtcaaaataaagcacatgtattaaatttttaatcctctccacgaatgtcattttaccacttaattcagacagaacagcaggtatgcgggaagtggggaatagaagtcctccactatacttctcaagtgtgtagccaggagactgtcaacaaaggacatgtatttaacatgcctttaacatgctcagctagcagttcaccacaggcaccaagggcatctgcaagaacgacatcaaactttgactcttgtagttttgtcgtaattttcttgttcaaaactacatctttacagagattattaacacagtctgtagattcccaaaagagttcttgtgcttgtgagaaatatgaccaaaatgcatctttctgaagatcgtatatccatctattgatcagtttcacaacaagaccctcaaaattatttttaattagagatgttggataaacctcaaatctaatagcagatgatttactagggtgaataataatggaagccaaagatgacagcacagtcatcttatggcctctccaaacaagttcatccaggattgtctttatattcatccaatggctgtattctgtgggccacactagcacctttccacaactcccagaactaaagtgacaactgagttgtatcaggagaatatttgacatcgatttcatagttctcctggtgcaatgcaatgcttcttttcaaatcgctgtttctttctgtttttctcctacttatatctgaagataaatcaatcaagtgaaagtataactgctacaattcaaagtagtagttaccatataatttctaaattaccataggaattgtctgttaccatataatttctaaattaccataggaatttccagattgtttttcacagtggatgcttcaatttccattctcaccagcaatgtataagaattttaatttcttcccaaccttgccaacacttgggattatatttcgtttgattatagccagtgtgaatgaagtgatatctggttatgctttacctttctttgatatgaaatcatgttgagcatgttttgcctaattttggttgaattatttgtcttcttatggacttgtgtttttaatatctttctgatataagaaccttatcacatatatgatttccttgttttttttttattctttgggctgtccttttactttcttaacggtgttcattgaagcacaaaagtattgattttgatgaagtccaactaatcaattttaatttggttgcttttatttttgattttatatctcacaaaccatttccaagttacaaaaattagtacctgttatttattattagagttttatagttctagtgcttacatttaagtttttgatcacctttgaattagcttttgtaagtgatttgaggtagagggtcccaactcaattattttgtatatggataatcattattcccacttatatttgttgaataatctattctttcccccttaaatagttttgaaacttttgtcaaaaactttaaatgcatgggtgtatttctatattctaaaatccattccattgatctacatgtctatctgtaggcctgtatcacactctcttgattattgtatatttgtatttgtctttaaaagcaggaaatgtaagttttccagctcatttttattttaaattgtttcagttttttaaaaaatttttttcttcttgctttttttctttaagaggtagaggtgttactatattgcccagactagattcaaatttctgggctcaagcaatcctcccaacacagcctcttgagtagctggatttacagatgtgtttcactacacctagcttcttttggctattagtatgtctcttgaatatgtataaatttcagaatcagcttgtctgtttatgcaaagaagtgatctgggattttgatagggattgcattgatttggtatatgaatttggggagtagagtatggtaattatcacaatattaggtctttcaataaatgaagatgtgatgcctttctatttatttagatgttcttatttccacagcgttttgtagattttgttacagtggctagctagtcagacacaaacagggcagaagacggctcccacaccctaccaggaaagtcagatgaccatcagttaatggtcaggcagttgtcacactgtctcgctaaaataataattggttgcagccagccagagaaaggcagctttcctataaatagaaaaaatcaaatctggtaatcagcagcttcctgataagatctcaggagttgggtgagtgggctcacgcatgcacattaagaggccaaatggtggagtaagacattccggtggcaccagaaaagggaagaatgcctcaggggagcattcatatgactccagtaaacatactgtgcatactcatctcctaagtgctagcaggccatcacacataccagcaggtcaccctaaggaaagaatcaaggaaaatggaagcaggatcctggaagtatgccaacatataaaaccctaagtcaaaggtcaaacactgcactttaccttcaaaatggccacttggatataccccaagtgtactttcctttctttcctgctataaacctttttaataaattttcacttttgttctgaaacttgtcccggtctctttttttgccttgtgcccctcaatcaaattctttcttctgaggaggcaagaattcaggttgctgcagaaccacaaaaatttgctgcagtaaccaccactagtaataatttcacagtgagagttgtacaattttttgttaaacttattactaagaattatattttttcatggtattataagggtgattgtttaatcttcattttagtttaaatttccattgcaattttgtagattttttgttttcttatcttggatcccaaaatcttgttttattggtttacttgaatattttttagtggatttgtaaaaatttcctattacaagatcattatatatgccaatagagatagtttaacttctttctttctaatgtggattccttttatttcattttctttcttatttgttgactgaaatttctactgcaatattgagtggaagtgagaagagtcaatttagtgtgatgttagctgtgtatttttttttttttttttttttttgagacggagtctcgctctgtcgcccaggccggactgcggactgcagtggcgcaatctcggctcactgcaagctccgcttcccgggttcacgccattttcctgcctcagcctcccgagtagcagctgtgtatttttttatagatactattgatcagttttaagatgttctcctttacttctagtttaagtgttcttatgatgaagagtattgaatttcattaaataagtttttctgcagttattgaagtgattatgcagttttttcctttattctaatgatatgatatactagttggctttttcagatgttaacataactttgcattcctggaataaaattcatttgtttatggcatttaagcttttcgtatgttcctgaattttctttgctagtgcgaaaggaaagtaaaaatcttgagacattaaactcactatgtcaaagagaaaagttaatcttgggaaacaaaccatgtaaaactggctcccattttgttcctaaacagataaatgcaaaaatagaaggccacatacctctccagagggcctccttcccaatttactcacaaggaaaatcacaaggtcctaaaacagagttctcttgacttttaccctgagagtataaattaacattttatatttgcaggtatataaaagacaggacttgaagccattgtgtggtttttagcataagggcttactgaatggtggttatgttttctcctcttttattttttggaggattaattattttaaatatttgatagaagtatagagctttgatattttctactctaccatttccagttattaccccactatttttttctaaataatatttcactggaagccatcagacactggcttttcttttatgggagactttttccttacagcttcaatcttgttacttgttattagtttgttcaggttttttatttcttcatgggtctatcttggttggttgtatgtgtccaggaatttattaatatcatctaggttttccaatttgttggtatatagttgttcataatattctgtaataatttgtgtttctgtaatctcagttttttgtctcctctttcacttctgattttatttagtgggtctgttctcactttttccaacttagtctagctaacagtttgttgattttgtttacttttacagagtttaccttattgtctgtggctgcttttgtactacagtggaagagttgagtaggaacaagagtctaaagggtttgcaaattccaaaaatatttaccatctgaggctttatagaacctattctgatctctgcaggttcattttttcctttaacctttctatatattcaatatatatttctatatatttctgtattactatatattcaatatattgtatatattcaatgcaattttaataaaatagtatagatttttagtgagtcagatgatttatgtttaattatgttaataatgagttaataaattaatttgtatttccattttatttagaataggtgagtttgtttgttatgtggaatggtgcttctgttttaccttttttttgagaaatctctaaactgctttccacagtaattcaactaatttgcaatccaccaacagtatataagcatttccttttctctggatcctcactagcatgtggtattattattaatttatactttttagtaatagccattatgactagtgtgagatggtctcattgtggttttgatttgcatttctatgatgattagtgatgttgagcatttttgtcacgtttgttggttccttgtatgtcttcttttgagaagtacctgttcacatcttttgcccggtttttcacggggttacttgatttttgcttgttgaattattcaagtttcttatagattctagatattagacctttaacagatgtgtagtttgctaatatttcttcagtttacatctcacttgtgaattttgagttttgttgcaattgttattaaggacttagttataaattctttcccaaggctgatgtctagaatggtatttcctagattttcttcaataagtcttatagctttaggtcttatatttaaacatttaattcatcttgggttaatttttgcttggtgaaaagtagagatccagtttcattctttttcttatggctagcaagctatcccaccatcatttattgaatagggagtccttttctccattgcttatttttgttgactcagtgatagatgactataggtctgttgctgtatttctgggctctgtattctgtttcattgatttatgtgtctgtttttgtaacagaaccatgctgttttggtgtctgcagccttataacatagtttgaagttgggtaatgtgatgcctctggctttgttctctttgctgaggcattcttcagctatttgggctaatttttggttttatggaaatttttgaatatttttttctaattctgtgaataatgacattggcattttaataggaatagcatttaatgtgtggatggctttggttaggatggttattttaatgatattgattcttccaaccctgagcataaaatgctctaccatttgtttgagtcatctatgatttatttcagcagtgctttgtagttcttgtagaaaacttttgtctccttggttagatgtatttttaagtatattttgtttgtgtgtgtggtataaatgtgattgtgttcttgatttgactcttagcctgaatttttattggtgtatagaaatggtattgatttttgtacatggattttgtatcttgaaacattactgaagtcatttttcagttctagcaggctttaggcagtctttaggattttctaggtatagaatcatatcatcaccaaagaacaataccttcaattcttttcctatttggatgccttttatagctttctcttgcttaggtgctcaattaatacattattgaaatagaaagtgctgtcattttaatcatttatatttgaaatataaaattttaaaaatttatatttgaaattttaatcatttatatttgaaacataaaattttaaaattttaaaattttaaaagatttggactatgttaagtccaaattcattgcagaaatgtacttatccatttaataataataatagttatagcaaattgaattttgctatatacagcaattacatacagcaactcttttagtctcagcaatgctattaagtaggtagtgacattgcttcatctacatttcactgaaggagaatgtgaggcatagacctgataagtaatttgcttaaccataagtgattctgtaatggttttgcaaagatgatataggttatctggattcagagtgcaagctcttacccaccatcctatgctgactactctttctgggttacaggtagttacaaaatgtaatatagattcactttttttgtaggtatatattaattttaatattattacaggagtataactcaaatatgtaaaaatatttttctggttgtctatcactgcttaaccaactgctctgaaatgaaggtgcttagaacagcaacattttatcatcatctgttttaattctaggttgttggccaggctcagttaggtgtttatggcacagcatttctcagttggttactgtcctaaggtagcttgggctaatcatctgaaggttaatcactcacatatctggtgattagtattaaaagtctcaagctactgcagtgctgggccaattgtgacttattaggcatacatatgtatttctacaccaaatggtatatttctcctggggactgtggatatagcacagggctccaaagcgagtggagagacagagaaaaaggaaaaaagaatgacagaaacacagagaaaaggacagaaggacagacagagaaaatgtattaacaatttttttgagctttggaagttaagctcctcacttccactatattctcttttttgagacagccacaaaatttgctaaatttcacaggaagggtatatgacttgatgagaggattgccaatgcatttgtaatcacatctcaaaattactgcgaatataaccttaaaaattagaagaaatcactaaactactgtagaattcataaaatgttgacataagacattaaaattttaaaaatttgtttgctaaaattttagccataattaaaaattttaattaacattctaatatatttattaataaatatttaaaatatcaagtaggtgtccaaaaacaggctgtaaatttatcagatagagagcaccggattgctggtcaatttaagttttctaaatggcactaatggattgataatattatattaaaacccaagaacatgctatctcaaatcaatgtttatttcactaattaatttttaaaactatataattaatatataaaaacaaatttgtgaaaggttagtgaatgaagtatatagaatcaaaattaaaagtagaatcctctatgtttatacagatttacagattcttaattttatttcaaagaagaatatcatacttttttttctgaaactttttttcatttagcaatgtgatgtggagagcattccatgatattgtctgtaatatgcctgttctctgtaattgctgcataccttctactttttgtggtaggtatgtatgttcattgactgatagccaggcaagtgatggagggaacatcctgtacatacatgcactcaggtgcaagtatatctggatggcagatgactagatgtagaattgcagagtcaaactgtatgtttaattttttttgtaagagttgtttcactttatactctctcacaaactcttttctcagattcttatgtttgatcaatctcctgtgggaaaataattcgttgactttttatggctacatagtaatccatggtgtatacatactgcactttccttattcagtctaccattgatggacatttaggttgatttcatgtctttgctattgtgaatagtgttgcaatcaacatatacatgcatgtgtctttataatagaatgattatattcctttgggtatatacccagcaatggcattgctgggtcaaatggtatttctgtcattaggtcttggaacagacaaccaaatgctgcatgttctcacttacaagtggaagctaaatgatgagaacacatggccacacaggaagctaagtgatgagagcacatggaacacatgaacaacacacactggggcctcttggagggtagaaggtgggaggggggagaggatcaggaaaaataattagtgggtactaggcttaatacctgggtgttgacacatatttacctatgtaacaaacttgcacatgtacccctgagcttaaaataaaagttaaaataaattcattgacttaaggttattgacttactaaattataatgtccaactttctagtacaagtagccatctttttgatgtgattggccatttttacttctgtgaattgtcaattcatatccttcatctattttcatattggtctgtttgtctttttggttggtgatatataatagctctcactatacaagagataccagtcctttatctatgtgttgcaggataagcttgatgtaaattactttaggtttgtatgcatgatttagcaatattatctactatgacactatattcattcaatttttcttaaaaatgtttcatttatctagatacattttataaaaatgttgctgcaatctcttccaataattcccttagcatcaaaattttaatttatttttagaatacattcatgccataggtcatagagtggttattgtgagacttggatgatggtcttcttaccaataaagacacataggtttgtgttaacccatactactttgatcataaagtgtttccttgatgtgtagcttttaagagggccttgagaattcctgagattttattatttgccaatttttggtaatttttgtggtcttttaattgttactgattatgattagttgcaatatgcttacattttaaaaaatcattatcctatttttggtcatgctaaatgacttatgttttcatattagtgttatgggatgaatagagttacaggcttctgaggaaagagagaaacatgagacatccttatataaaatagggttatatagaataattatcatttttaactgtcttctacaaacacattcagtttcacaaacatctgtaaggcagctcaataattctgtgccttgttttggaagaagtgaacacatatatacatgtacatttgtgataatcaaaatcagtaagtccccttaaagtgctggttttatattatcacaacctacaattcagacattttatccaatattaaagtttaaaaatgaccgtgaaagcaaccagttcacactttagaaaagttcatggggaaaagagaattagcttgtgaacaaaggttttcccaaatagttaaattttgtagtatttgtcaggtaggagtcattctatctctaatttgttgttctccaactccaagtctctgagtcccattattttgctcttcaggccctgaatttggcataaagtgtagtagaggcggacagtgtcgtctcctgtgcatcactgttgttttgcgaagaaattctcaatgtggtcagctgctgctgctacagaagtcgattttctttaaacactgccaagaacatctgacttacatagtatattttgatttgatatttattcaaactgagcctgctttttttctttttacaaactctctaaaactgctaaaagtcttcactttataaactatgtaattaccatgatctttatactgttggtaaagcaatggttcactttccccatgtctttcacctcagttcttttctcccctgtgtgaattgtatccattttgttcaaagtgattttactgaataccaggagttatcacctctcaagtgttattggcaatgagattgtttttgccagttatcagtgaattattaaattccaaagtcccttgttgagggtctgctttttagtgccacttgcccaagctgccatagtctatttttctcagaaagcaaagcctgagataagaattagtgtgcaataacttaatttgagaaatgttcttagggtacaggagtaggggacaggaaagggtgaaacaagaagggagaaaagtcagtacaagaatgtgttaccaaactaatcatcaccataactgttgggactaaagctcatgcggacccagtaggaagttgtgtggatgtaaagcgtgatcattaaccatcactttctattgctcacactgccaggttatgcatatgtgagtgagtgctagctgagtttcttcgagggttccatgaagagatgttaaagaagtctggtgcagaaaatgagagacctgtcctatcagaagacgacttcacaaagctccttgacacagcaaaggctagagaaaaaaaaattagctgaaaaaatatggggtgcaacctaatttgatcaaatgtattagagctttcttttttcttttgtttcattttcacagtatattacttttcatatgattaaatactgtaaattttctcaggtttctgataaagttatgcctgtgatacaggagctagaaagaaattatttaggcagatagtgagggtgaaagtccttggtaaggttttgttttaataaaaagcagccccccaaatcatttccttgctaacaaaaagcagccagaaaaatcaagcttcaaacctagataaacaagctaaagcttgcataggtaaatgctggcaactgtgccagtaattcctcaaggatctagaactagaaataccatttgacccagcaatcccattacttggtacacgcccaaaggattctaaatcattctattataaagacacatgcacacgtatgtttattgcagcactattcgcagtagcaaagacttggaaccaacccaaatatccatcaatgttagactggataaagaaaatgtggcacatatacaccatggaatactacacagccataaaaaaggtaagttcatgtcctttgcagggacatggatgaagctggaaaccatcattttcagcaaactaacacaagaacagaacaccaaacaccacttgttctcactcataagtgggagttgaacagtgagatcacatggacacagggaggggaacatcacacactggggcctgttgaggtgtggtggactaggggagggataggattaggagaaatatctaatggaggtgacgggttgatgggtgcagcaaaccactgtttcacatgtatacccatgtaacaaaactgcagattctgcacatgtaccccagaacttaaagtataattaaaaaaaaaaaagaaagaaaagggatgggataccttgaagccaggtatattcaacatggatattcaacgtggaggtcccctctttccttttctttgtcaaccatatgtgcagtaaagaagcagcaacatggcactggccatgtagagaaaccatttgcttattgaaaattaaggtggggcagacagcttcttcttacactatgtaaatggcacacctggttccaccaatcctttgtgccctatataaatcagacactgtttcctcaagctcatctataaatccctgtgcatttcaccatgggactagaagatccattcgggagcacctttctgcagaaatgagagctattctcctttctctttctttcccctattaaacctccattcttaaactcacttctcgtgtgtccatgttttcagtttccctggagtgagatgatgagttttgagtatttaccccagacaatgatgctgcttaacctgttacttttatttattcttatttttaaaatttttatttattttttatttattttactttaagttctgtgatacatttacagaacgtgcaggtttgtggcataggtattcatgtgccattgtgatttgctgcacccatcgacctatcatctaggttttaagccctgcatgcattaggtatttgtcctaatgctttctgtccccttgtcccagaccccctgacaggccctgatatgtgattttcccctctctgtgtctatgtgttctcattgttcaactcccactaatgagcgagaacatgtagtgtttggttttctgttcctatgttagtttgctgagaatgatggtttctatccatatccctgcaaaggacatgaactcattttttatggctgcatagtattccatggtgtataggtacacattttatttattcggcctatcattggtaggcatttgggttgtttccaagtctttgctattgtaaatagggctgcaataaacatacatgtgcatgtgtctttatattacaatgatttttaatcctttgggtatatatccagtaatgggattgctgggtcaaatggtatttctgcttctagatccttgagcaattgccaaaatgtcttccacaatggttgaactaatttgcactgccatcaacagtgtaaaagtgttcctatttctccaaatcctctccagcatctgttgtttcttgactttttaatgattgtcattctaattggcatgagaaggtatctcattgtggatttaatttgtatttctctaatgaccagtgatgatgagctttttttcatatgtttgttggccacgtaaatgtattcttttgagaagagtctgtttatagcctttgcccactttttgatggtgttgtttttgtcttatatatttaagttccttgtagattctagatattagacctttgtcagagggatagattgcaaaaaattcctccattctgtaggttgcctgttccctctgatgatagtttattttgctgtgcagaagctctttagtttaattagatctcatttgtcaattttggcttttgctgcaattgcttttggtgttttagtcctgaagtcttcgcctatccctatgtcttggtattgcctaggttttcttctagggttcttatggttttgggttttacatgtaagtctttaatccatcttgagttaatttttgtataaggtgtaagaaaggggatcagtttctgttttctgcatatagctagcaagttttcccagttttcccgttgcttgtttttgtcagttttgtcaaagatcagattgttgtagatgtgtggtgttatttctgaagcctctgttctgttccattggtctatatatctgtcttggtaccagtaccatgctgtttttgttactgtagctttgtagtacagtttgaagtcaggtagagtgatgcctccagccgcttttttttgttttgttttgttttgttttgcttggggttgccttggctatacaagctcttttttccttccatataaaatgtaaagtagtttttctagttgtgagaagaaagtcaatggtagcttgatttgaatagcattgaatctataaattacgttaagcaccgtggccattttcatgatattgattcttcctagctgtgagtatggaatattttttcatttgtttgtgtcctctcttatttccttgggcagtggtttatagttctccttgaagaaatccttcacgtctctttttagccatattcctaggtactttattctctttgtagtgcttgtgaatggaagttcaatcatgatttggctctcagtttgtctattatcagtgtataggaatacttgtgatttttgcccattgattttgtatttggagactttgctgaagttgcttatcagcttatgaaatttttgggctgagatgatggggttttccaaatatagaatcatgtcatttgcaaacagagacaacttgacgtcctctctttctatttccataccctttatttctttctcttgctgattgccctggctagaacttccaatacaatgttgaaaaggagtagtgagagagggcatccttgtcttgtgccggttttgaaagggaatgcttccagcttttttgcattcagtatgatatgggctatggatttgtcataaattgctcttattattttgagatatgttccatcaatacctagtgaatggggagtttttagcatgaaggtgtgttgaatttatcgaaggccttttctgcatctattgagataatcatgtggtatttgtgattggttctttttatgtgatggattatgttcattgagttctgtatgttgagccaggcttgcatcacggggatgaagctgacttgattgtggtggataagatttttgatgtgttgttagattcggtttgccagtattttattgaagatttttggatcaatgtccatcagggatattggcctgaaattttcttttttgttgtgtctctgccaggctttggtatcagcatgatgctggcctcataaaatgagttagggagaattccctctttttctgttgtttggaatagtttcagaaggaatggtaccagctcctctttgtacctctggtagaattcagctgtgaatccatctggtcctggactttttttggttggtaagctattgattattgccacaatttcagatcctgttattggtctattaagagattcaacttcttcctggtttaatcttgggagagtgtatgtgttgaggaattcatccatttcatctagattttctagattatttacatagacatgtttatagtattctctgatggtagtttgtatttctgtgggattggtggtgatatcctctttctcattttttatttcatctatttgattcttctctcttttcttctttattagtcttgttagccgtcgatcaattttgttgatcttttcaaaaaaacagctcctggattcattaattttttgaagggctttttgtgtctctatttcgttcagttctgctctgatcgtagttatttcttgccttctgttagcttttgaatgtgtttgctcttgcttttctagttcttttagttgttgtgttagggtgtcaattttagatctttcctgctttctcttgtgggcatttagtgctataaatttccctctacacactgctttgaatgtgtcccagagattcttgtatgttgtgtctttgttctcattggtttcaaagaacatcttgatttctgccttcatttcattatttacccagtagtcattcaggagcaggttgtttagtttacatgtagttgagtggttttgagtgagtttcttaatcctgagttctagtttgattgcactgtggtctgagagactgtttattataatttctgttcttttacatttgctgaggagagctttacttccaagtatgtggtcaattttgtaataggtgtggtgtggtgctgaaaagaatgtatattctgttgatttggggtggagagttctgtagatgtctattacgtccgcttggtgcagagctgagttcaattcctggatatccttgttaactttctgtctcgttgatctgtctaatgttgacagtggtgtgttaacgtctcccattattattgtgtgggagtctaagtctctttgtaggtctctaaggacttgctttgtgaatctgggtgctcttgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggcagatcttcctccatccttttattttgagcctatgtgtgtctctgcatgtgagatgggttttctgaatacagaacactgatgggtcttgactctttatccaatttgccagtctgtgtcttttaattggagtatttagtccatttacatttaaagttaatattgttatgtgtgaatttgatcctgtcattatgatattagctggttactttgctcattatttgatgcagtttcttcctagtcttgatgggctttacattttggcatgattttggagtggctggtaccggttgttcctttccatgtttagtgcttccttcaggagctcttttagggcaggcctggtgatgacaaaatctctgagcatttgcttgtctgtaaaggattttttttctccttcacttatgaagcttagtttggctggatatgaaattctgggttgaaaattcttttctttaagaatgttgaatattggcccccactctcttctggcttgtagagtttctgctgagagagctgctgttagtctgatgggcttctctttgtgggtaacccgacctttctctctggctgcccttaacatcttttccttcatttcaactttggtgaatctgataattatgtgtcttggaggtgctcttctcgaggagtatctttgtggcattcgctgtatttcctgaatctgaatgttggcctgccttgctaggttggggaagttctcctggataatatcctgcagagtgttttccaacttggttccattctccctgtcactttcaggtacactaatcagacgtagatttggtcttttcacatagtcccatatttcttggaggctttgttcatttccttttatacttttttctctaaacttcccttctcacttcgtttcattcatttgaccttccatcactgataccctttcttccagttgatcacatcggctcctgaggcttctgcattcttcacgtagttctcgagccttggctttcagctccatcagctcctttaagcacttctctgtattggttattctagttacacattcgtctaaatttttttcaaagttttcaacttctttgcctttggtttgaatttcctcttgtagcttggagtagtttgatcgtctgaagccttcttctctcaactcatcaaagtcattctccgtccagctttgttccattgctggtgaggaactgtgttcctttggaggagaagaggtgctctgctttttagagtttccagtttttctgctctgttttccccccatctttgtggttttaactacttttggtctttgatgatggtgatgtacagatgggtttttggtgtggatgtcctttctgtttgttagttttccttctaacagacaggactctctgctgcaggtctgttggaatttgctagaggtccactccagaccctgtttgcctgggtatcagcagtggtggctgcagaacagcagattttcgtgaaccgcgaatgctgctgtctgatcattcctctggaagttttgtctcagaggagttcccggccgtgtgaggtgtcagttctcccctactggggggtgcctcccagttaggctgctcaggggtcaggggtcagggacccacttgaggaggcagtctgcccattctcagatctccagctgcgtgctgggagaaccacttctctcttcaaagctgtcagacagggacatttaagtctgcagaggttactgctgtctctttgtttgtctgtgtcctgcccccagaggtggggccttcagaggcaggtaggccttcttgagctctggtgggctccacccagttcgagcttcctggctgctttgtttacctaagcaagcctgggcaatggcaagtgcccctcccccagccttgttgccatcttgcagtttgatctcagagtgctgtgctagcaatcagtgagactctgtgggtgtaggaccctccaagccacgtgcgggatataatctcctggtgcaccgttttttaagcccattggaaaagtgcagtattcaggtgggagtgacccaattttccaggtgccatctgtcacccctttctttgactaggaaagggaactccctgaccccttgcacttcctcagtgaggcaatgccttgccctgcttcagcttacacacagtgtgctgcacccactgtcctgtgcccactgtctgtcactccttagtgagatgaacccggtacctcagatggaaatgcagaaatcacccgtcttctgtgtcactcacgctgggagctgtagactggagctgttcctatttggtcatcttggctcctcctcctaattcttgaagatttcattggctaaagtaaaacaaaaattctgctcaaaatgaagccaaaatattttgagtatttgcaaaacaatgttgatactatgagtggagttcttaatgttgttgtgttcaaatacaatgtgtgaaacataatgaagctcagtaactttcgtgtgtaacttttggattagaataataaatatcaatataagcccataaggttttatattatttttatttttcttttcttttttttttatggcttggatgacactttattttcagatccaatactagaagttgtttccatgttcacattttccttcctggtttaaaaaaaagagttgtattttttttttttgctttttttaaattatactttaagttttagggtacatgtgcacaacgtgcaggttagctacatatgtatacatgtgccatgttggcgtgctgcatccagtaactcgtcatttaacattaggtatatctccaaatgctatccttccccccattgtatttttcatagcttaaaaatcattgacatagaataattcagctaaagtacgtattaaatccctggaaaataaattttgtcttaacaaggtaagttgtgaaaagatgttttgtcacaggaaaaaggaaatcctccatttaaaaccctccatgctgaaataaaggaggagtcccatctttcagtcattccacttcaggcttttgatataactaatctcttttcttcttctttccttttttggcaagctttcggaaacaaaacaggcaaaattttgtgatgataaatatcacagttgccacgcaggccagcaggaatgctatcacatccaaagagtggtactggatccaggtgaggttgtgagctgcgactcgaaggtgcttggctcctttgtggcgcatgacaaactcaatccagaagactgctcgatccaggggcttcattggttggtcatgatgaattcttgataatttcatgacattctctttatagctgaaggataaatataaagatatcaacattaaaagtaaatttattgcttaagcatatcaagtctatggatggtctttgaaaagtgtcacacaaatgattgaaagtaagtgtcactgaattggcatgaaatttcaatgttttaattcatgtcattacagaaagtttggtttttaaattggagttttatcactgacaaatacctttaaaaatgaaaaatggaattttcggtgggaaagttaatgttttctggagcagaaaatattatgagccattctaagtgctataagtaagatagtggaaatggaatttgagaatgatctttttgatctttttaatttttttttattttttgagacaggcttttgctccattacacaggctgagtgcagtcacatgatcatggctcagttcagcctttctctttcggtctcaagtaatcctacatctcagtctcatgagaagctaggactacaactgcacaccaccatgcctggctatatttttttattttttacacttttagatatgaggtgttgctgtagtgcccatactggtctggaactcctgtagtcaagtcattctcctgcctctgcctcccaaagtgttggccctacagacatgaaccactgtgcccagcccattttgacgtatttaaagaagaattgtgacacaactggtgaaatgcctcctaactagtttctcagcttctactctaatcttttgtcttctaccatattttccttctagtagccagaatattttccaaattaatatcaaattatgacactcacctgttaagatttccatctggtttcttgttacattaagaataaattccaaatctgtctttggtctagagaactctacacaggcacctacttgtcctagccctttccccctgtacactttcttctagagacaatggccttcggtttttctctaaactcctgaaggtgttctcaccttagcccctttacaccttttgttccccgtgtctctctcattgagcattctttcttgcaactacttgaggtttgcttctatttctttttgaggcttccccttgtatgatacctcttggagagtcttttcctggccacactataggcacccataggatttctctagtgcttcatgcttactttgctatttgatttctggaactttaaaatatgttgtatatcttctacagtaaaacttcaagtatgaaatacataggataaatgtatatatactatgtgactacctcaaaattttaagattatcttaaacattatcccaaagtgaagacaccaatttatcacaaactgcatagaagaactctctcctcctgggccattttagtcactatttttatcctcaaagtaagtattaacctgatttctgatatcatagattagtattgtttatataattgaattaaataatacatattcatttctgtttttggttagcagttgtttaatagcattggtgtagagagtattcagttgattgacaaagaccacagatgatctcttcattttgtgattaatggatatttgtgttgttaacattttttgaccttactaataattatggtattaagatatttgtatattttattaggtttaaatatttattcatttttgttggatgtatacttggaagaatagttgatgagagaaaggcacatttataattagaattttttgttgactgaattttttaaaaaatattttttattttaaagaatcagattgttttcagttatcgtttttggatgatttataatttatttctagtatgactagaacatataatttttatgaatttgaatctgatacaatttacttagtgtttatttatggcccagcatatggtaaattcaggtaactatttcatataatctttttttttttttttttttttttttgagacagagtctctctgtcacccaggcttgagtgcaatggagtgatcttggctgactgcaatttgcatctcctgggttcaagtgattctcatgcctcaatctcccaagtatctgggactacaggtgctcatcccctacatctggctaagttttgtattattagtggacacaggatttcaccatgttggccaggctggtctcttaactcctgacctcatgtgatcctcccactttggcttcccaaagtgtcgggattacaggtgtgagccaccacacccggtctccataaactcttttaaaaatgtttattttctgtctacacacacacaaccagagatatatgtatggatacatatatacagataaatgtgcaatatatatacacacacacatatataacacatagattacatttaattgtgtacttcaaatgttttatctccttaaataaaatatttcaaagatcactattttgtcttttctttttggtctgcttaaatttaatgtgagtactggtaggttcacttttttgtttttttgcttttttgtttttttttgagatggagtctcgctctgtcaccaggagttcagtggcactatctcggctcactgcaacctccgtctcccgggttcaagtgattctcctgcctcaacctcctgagtagctgggactataggtgcacaccaccatgcccagataatttttgtatttttagtagagacagggtttcactatgttggccaggagtatggtctcgatatcttgacctcgtgatctgccctcctcagcctcccaaagtgctgggattacgggcgtgagtcactgcacctggtcagttcaaatttttttaaaaagttttatttttactttaagttccagtatacatgtgcagaatgtgcaggtttgttacatacgtatatacgtgccatggtggtttgcagcaccgatcaacctgtcatctagattttaagcccctcatgtattagctatttgtcctgatactctcactccccttccatcccccggtgtgtgttgttcccctccctgagtccatgtattctcattgttcaactccctcttataagtgagaacatgtggtgtttggttttctgttcctgtgttagttgctgcggataatggctttgcatttcatccgtgtccctgcaacagacatgatctcattcctttttatggtgcatagtattccatagtgtacatgtatcatattttctttatccagtctatcactgatgagcatttgggttggttccatatctttgatattgtagatagcgctgcaatagacatacatgtgcatgtgtctttatagtagaatgatttatatgcctttgggtatatacgaagtaatgagattgctaggtcaaatggtgtttctggttctaggtctttgaggaatcaccacactgttttccatgatggttgaactaacttacattcccgtcaaaaatgtaaaaagctttcctatttctccccagcttcaccaggatctgttgttttttgactttttaatcatcgccattctgactggcatgagattgtatctcattgtggttttgatttgcatttctctaatgatcagtgatattgagcttttttcataagtgtgttggctgcataaatgtctttttttaagaagtgtctgtttatatcttttgcccactttttgatggtgttgtttttttttttttttttgtaaatttgtttaactttcttgtagattccggatattagacctttgtcagagggatagattgcaaaaatcttccctcattctgtaggttgcctgttccctctgacgatagtttattttgctgtgcagaagctctttagtttgatttgaccccatttgtcaattttggcttttgttgcaattgcttttggtgtttgtgtcatgaaatttttgcccatgcctatgtcctgaatgatattgcctaggttttctcctagagtttttatggttttgggttttacatttaagtctttaatccatcttgagttaatttttgtataaggtgtaaggcaggggactagtttccgttttctgcgtatggctagccggtttctccagcaccatttatttaatagggaatcctttccccattgcttgtttttgtatggtttgtcaaagatcagatggttgtagatgtgtggtgtttttctgaggcctctgttctgttccactggtctatatgtctgtctttgttccagtactatgctggtttggttactgtaaggtgtaaggaagggatccagtggcagttttctccatatggctagccagtttttccaaaacatttcttaaataaggaatcctttccccagttgcttgtttttgtcaggtttgttaacaatcagagggttgtagatgtgtagtgttatttctgaggcctatgttctgttccattggtctatatatctgtttggtaccagtaccattctgttttggttatgtagccttgtagtacagtttgaagtcaggtagcatgatgcctccagctttgttctttttgcttaggattgccttggttatatgggctcttttttgtttccatatgaaatttaaagtagtttttttctaattctgtgaggaatgtcaatggtagtttgatgggaatagctttgaatatataaaatactttgggcagcatggccatttttacaatattgattctttttatccatgaggatggaatgtttttccatttgtttgtgtcctgtcttaattccttcagcagtggtttctagtcctccctgaagaggtccttcacatcccttgttaggcatatgcctaggtattttattctctttgttgcaattgtgaatgggaatttattcatgatttggctctctgtcaaatcatgtactgtcagtgtatagtaatgcttgtgatttttgcatattgatttttgtatccagaggctttgctgaagttgcttatcagcttaaggaattttggagctgcgacaaaggggttttctaactatagaattatgtcatctgcaaacagagacaatttaacttcttcccttcctatttgaataccctttatttctttctctagttcacatttaaatccagcatcttattctatatatatatatattttaattttctaacctgttttatgtttctttactttcttactttttttgaagtatcttaaatcatttcttgtcttactaattttttggtaaagtgtttttaatgtattcccttagctggtaccacctaacctcataataatattggtaggagtaatagactctgaattgatggtagctggtctaggcacagcatttttcatagtatttcctttggattatggaaaagttaagtattacatatttattttatcaacattgaaacctttgtatttcaaaaggcatcttccaaaaagtaaaaaaaaaaatctatctgtccatagtggaagaaaatatttgaaaatcacatatttgataagggattgtatctataatatataaataattcttatgaatccataagataaatagaaaaagacaaaatattcacaagattaaaatagaaatttatctaaggaagatgtgtgaatgaccagtaagcacatgaaaagagggttaacatcttcagccataaggaaatgcaaatgaaaaccataatgagagaccactttacacacactagaatggctgtaatagaaagacaggtgataacaagtgttgggaagagtgtgaagaaattagagccctcctatccagctggtggtaatgaaaaatgatgcaaatactttgaaaaacagtttagcagttcttcataaacaacaatttcccatatgtctcagcaagtccactcctagcatctcctcaaaagaagtaaaaacatatttttacacggaaaatatgtataacaatgttcataaatgccaaaattggaaagacctaaaatgtccatgacctgataaatgggtaattttggtataaacatatcaaagaatattatatagaaataaaaatgaatgagttctgatacatcctacaacataaataaaactaaaactaattatgctaagtgaaagaagtcatttatgaaacaccataaattgtatgatttcatttatataaaatatgtgaagagaataatctattgagaaacaaagtaagatggtatttttctaggactagaggtttattgggagtgacttcatacattatgagtttaatttgaattcattaaaatgttctttagggctgtggctttgtaactatgtaaacatactaaatatatttagattttaaattttagtgaatgttatgctatgcaaattataattcattatcacatttcttaaaataatgataataaaaataaatttttgagaaagaatagattcatactttcagaaattttaggtattgaattgaaatatcatatttctctagttatgttctttcttttcattgtgcattctatcattaaaaatatttaaaataattatctacatatctttaatttttttgattttataattcattgcagtcattggtgacccattaaatctgtggggttgaaatgtaactttgaaataaactgtctggtggaaagtaaggacagattttacattggttaaatcacttcaatcccttcaaaattagtctcttaaaaacgggttaaaattcatattcactgttgacaaaataatttataaataccacctggtcacaaaactgtaatactcacacagggtcattaatgactgacttcaatgcattgagcaaatctctacttgacatggtcctgatgtccacactgagggctgctcccttggctttcatgtgagcaatgttatcatgttgatccgcaaacaagggaatgcccaccatagggatcccatggtagatcgcctcatagatgccattggttccaccatgagttataaaagctttggttttgggatgacctaaaagtggatgcattttaacaaaattattaattacaaggtatgagaattgaataagaaatgcacaatataaggaacttaaagcaaaactgttccctaggtaacattatacccacaaaactgcattgaaattgttttcaaatttcagaagaattgccaggtgaacaaaatgaaaaagcatattcttaattaaaaaattaaaatgtgcaaaaaaaagaataagattgggtatacaagaacgtggtcttttaagtattataaataatgaggtcacatttacatatttaaaaaatatttaaatacttaaaatatttaaaatatttaattttttttaaaaggcagcagggagtagggtggaggtggggctgaggaaggaccggttatgcatcatcatgaaatgtgttatcattttatcatgataaagattggttatttattcccataaaaagtagagtcactggtaatagaaaagtgtccgctatttttcagtgcctgttgaaataaccctgcagtaggggaaagaacagaggtaaagctgcataaataggagacagacagaaaatccaggatgttatttaaaacctgtgagaggaaattacacctgaacaaagagatttttattctgaccataaagaatgtgactgtatgtaataaaatgccaactactatagtgcattctttttatactaagactggaaaataaatataaagtagttaaatttgatttgttttttagttttccaataataaatgctaaatatgtttgttttatgttgaactattatcactccaatttgctgttactaatatattcactgtttgttctccagaatcttaccaagaaggtcattctggggtaaccacttgtacagtcgagtattggaacctaaagtatttggcttcttgccatcaaatctccatagaacctgttagggcaaggaaaatatcttgttcaatgaatagaactctaaaaacatagcatgttagaattctgaagagattaataatcagttagttaatccatataaaagatgaagaaataagaagaagtgatgtcaagtaatgagaactactaaaagtttgaggtaagttgaatacccacgtttaatgtcgttacttttataatcaattttgtatataaagaaataatgacatttctaacataatagctagacacatgagattgtgaaaggaaaataaatcttggcaacccaaactctatgctaaagggaaaagttaagctgcttagggcaaacctacctcccattctattcaaagtcagcccttgactcactgagataaatgaatatcaaattgcctcatttcgagaggctaatcagaaactcaaaggaattcagctatttgtctctcatctacctatgacctggaagccccttccatgcttcaagttgctctgcctttgtttctagctgtctcccatttctggaccgaacaaatgttcatcttatatatgttgattgatgtctcatgtatccctaaaatgtataaaaccaaactgtccccccaccaccttggacacatgtcatcaggacctcctgaggctgtgtcatgggtgcacattttcaaccttggcaaaataaactttctaaattatctgagaactgtctcatatattcagggttcatattttggtaaccatgaagagattctgagtggaggttccctgacctttgataaatgtcctatcagtgcttggtaccagcatgagctaaatttatggctcaaacaaagaagacaattggctgaggtctgggagcaacccctccagagaatctctgataccccaaaattcagacaagatctgaagtttattttgctgtacaactcctttttgttttttttggagttttacttgcttcctacaagaaaggcaagatttcctgtttccatgacaatggaaggcaggtaactctatggagtttgagctcgctcccaggagggaggatgaatttgaggtttctttcctgattctaggatggcagagggcagttttggcctgaaacccatccgtaggtaaacagctgaattgcggttttgtcttggttaatgtttaacaactagctggacttaatttctccttaccattacagtgcttagtgatcacatttctgggatttttttttttttttgtacattccagtatttctcccatcagatttgatgaactttacctgacttgatcaaatctgagtgagaattccaaattgtgggtaacaaagcctgtctaatttggctaaaattctttgcagacgcaaaagagaaaacaaaacaaaacaaaacaaaacctaaaaaccatgctcttggtttctgtgtttgcttcctgtctttaaaaaaacaaatgttcttttgtttacttttcctccaccctatacctccttttgccttttgccatttgcagtatgaaaaatctagagaaggcttctaatgacttgaactcttttaaagaattcagaacaaaggcaccactcacccctttaggggtgtctgttttctttgtggagttccaagagttgtgggcagatttttttctcagtccaaagctctgttttcctatgttgaatgacctgatctctttggctttgagattaccacagattaccttgtactgtgagaggattttaccttggcatgtgtaatggcagacgagttacaaagtagggggtggctgagtacagtttactggaagtagtattgactgttgctatttttttcctcctaggaagttgttgtttaagaatcctaattctagtttggagatgtgttgtaaagggtctcctctattgtttttattccccaaattaatctcatttggcttgtctgtgtggatttgtgtgagaaactgaactgtggtttacataggaaaatgagagactgagttttctcagctccaaagtgaaagggcatctgctcctcccaggcaaaaggcacccctaagcaactgggggccttgtgggagtgtcttggggttgaccccctgtgacatggagtggccctgcagggaaatccccaataaaaattaacttttaaaaaaaggctagtccaggaaacacatatgagggcagatcacccagcattttgagccctctcagaggtcatacacctctggagagagaaactgagacatgtaagagggtggaaacaactcagtggtgacacactgtggagtactgcccacaagcagcacacattgattcaccacacataaaccctaggccacagctcagttcctccttttaggaaaaaaagtgggaaacaaataatctaagaatgatgagaaaacaagaagaatgaccccctgatatcacttggtaggttttatgacacctctacttggcagagtttatgtaaaatgaaggtaatacggtctttgtgcacatatacattaagaaccctaggttgtcctgcaagctatagagttcctaagttctctctttttaaaaaaaattcttttcttcttgctttaaatttgcttttatttttctattaagataaaaaccacactatggattcaacaggtttttgtctgcaagctggtcaattttttttatctcatggctaaagttctgaagtaaaagccatagaatcttttgtgtgtgtgtacatgtgtttgcatatatttaaaaggccattataatttctataattttatgtttaataggcaattgaatccattttattttccttccagcacaccaaattttttgtctctgtaccttatgatgtaaattttgctatttaattttcacttggtttcttttaatatgcaaatgtaagactatttagcttacaactgcctatggtgatcaagtattcatacagattacctattgaaacaggttatcaagaatttggaagtctaatatggcaaaatgtagttttcataaatctataagatgtacttctattggcatgcttaatgtgtgtatgtatttatgtgttttgtacacagtgttttattactgaaaatatataaaagagctctaattaattggcttaagaaaataaaagtgcttgaattaaatactttgccagaaaaaaaagactagtcaaatgctttttcaagtttatgtaacttcaataaaatcttttataaataagataactttacaattattgctaaagtatgataatattagaaatgtcttaagaatttccagcatatatttttgtttgcatttattaatcaagcaatttcatacttattgttgccaaatactttaaggtgtcaaaatttgacataagggttacaaaactgtaaaccaagcccaaaacagaatgatctttgcttgtgtaattttttaataaataagacattgatattggtttaatgaaaatagccacatcttgaattaagtaagattatcataacttctaaccctgtggccttaagcaatctagtccacaggcagtaaggtttgttttgggaaaaaactgttatcatttttatttcaaagctaaaccataaagggtgtgaaatggcaacactatccttcaactcattttcaactcatataagtttttttcctcaagttctgtttgttgtggcataatgctaacagtgctttctaaaagctattcagctcctcaaggtccagggactatcacagaagaggtgggtgtgtgagattttaagaactgatactgagagataagttagtttatttacaaattaatcattaatgtcaaagacacactaatgcaagaccaacatatgggcccctgtgtcagattaacaaggttttctggaagcataaactgacttcttaataaagattataaaggttatgaaaggctgaggaaagttatatcttatggtcaagattagaattttatagattgttcataaaattttgaaaaacaaagttatttggcttcatgctattttattagggcttattgtttggcaaattgagtctcctctctcaaagaatgaagatttttgcctttttttgaaatccttgagttaccacattagtcaaatgaatgatttatcttacctgtgatattaagtgttttaaacctttgatatttgagaaattttccaaacaaattataaattatgattttttctgacctaagtaatcctttaatttattagtttccctaacatccaaaaatgacataatttggtttattttgtataaaaattatacaggaaacattgtcaaatatgaaatggtgtttggtctttttgagctgtatttatataagtatgttattgttatgtgttccaaaattatgggaaactcctataattctgatatgacttagtgtgtacgttatcagtaacaattatatgtgttaagttattgtgtgccacagaggtaacaaatttccttgtccattgtgtctttgactgagtctgccctaaaactttttgtcctccacagacaattgttgtcttactttggtcctctttagaaggcgattttatactcagccataaaattctaacaggtgctcttgaaaaaaagtttttgataattttggagattgtgacattagaatggaagaaaaactttcaggactcatggagaactaaaatgttcatgagtatcaagcagaacaggaattaactacatggactgaaataataaaaaactaaagtaatcttttagactttgcttaaaacattgctgatcctttgttttgtttttttttcagagtgaaggaatctttttttttttgagctattaacagcttttaacaatttagtatactcctatgaaaaaaatttagaacgtatttgtttccctctacctgatttttcagaatttggaaactatttgtgagtattttttacttttgtcaatacagttatttgcataagtgcaataagaatctattttcatttttaacaaaacacaattggagaaactggttattttatcaaggcttccactggtatggtgggctttcctttagggaatcaaacttaacttatggagccaataaaaccccttgggaaaactggcctcataccttcatctataaggtccctgtacagggttcctgaactgtgttaagcaaagaatgtaactttctgacaggcccaggagccccaagtttattttggaaccccaagaggagaggaattcacccaactcgtaggtatttgatggtagaaatctatggctttcctcagctttaaaaaagtcctatctgagattctttctataagacaaagttccatcaaagccactttaaaagcctatgtaaataaaaaattattcttcctcctctgtatacaataatcaggccaagtataataaagcaaatcagttgtaccatggtttgtctttagtaaaattgggaaactgaagacagaaaaattatgtttcaaaaataacagtatacctgttgttagattctagtcttgcctaatgtttttcaacttttattactgtctacagtttggactgaattctaatttttcatggcgacacgtcttcaaaatagtgtcttcaggttttttttcctccctttccaccatttttcctagtttggagtcactgtaaactaagtcatgctttcatgaagccctacaaattaagctagacaacttaaactccagaagaaaataacagcaaccaatttacatacataatccactttcatacctgcctactgatttatggacttcagagtaatgggcctatattaattttcaaggatttttcttttgtttggttttgtttttctccctttctccctttattttgtcttcataggacatgagacttcacaacctactaaaaatgaactttcctaataactcaggacctgcttaggaataaaccttccttgccattagagatcagatgaaaacctgagaccagagactcattttcttctaaaatgctttctccaaaagattttttttaaatgtaaaaggaaaataagcctgggggccccaaagtcactaagcaaatcactgcctcccattctattcaaagtcacccctctgctcactgggataaatgcatatctgattgcctccttggagaggctaatcagaaagtcaaaggaatgcctcctccctgcttcaagttggcaaaaataaactttctaaatgtactgagacctgtatcagatatttggggttcacaagattatcaatgaaatattcaaatatttaagaattgttaagcagtcttaattctagtaataaaaaagtagcaaattagtaataacctatatatttattttatatactttatactagctgtaaccttccaaatttaatataaatttattaatttttgagtgatatgagaagagtttacttatatccacttgtctactagtcataagttattttatgaatttgacatcattgattacaaaagactaaatatttaaactgcacatatggtgagaaataatgctacatatgtagtatgtgtaatttcttttcatttgctaactatcaagtgctactttcaggaaaaatttcaagtggcagtgtttgacacaaattcagactattatcagtattgctacttttgtaaatgctaacaatgtaggaaaaaggagcccattgacaattcatgattaacaatacagatgctgaaaatgtagaaaattgtattttgctgcattttgcttaactgatctttcacacttagatgatgcactacctagcattgacagccttgatatatggtcagctatagccagtcattaccatgtctagtaccaaactaaggtactgattttagaattcccaagcaatctttataaactggagtagaatttacaagtgttgaccttgtatttgatatgggagtgttaaagtaactctgtgttttcagcaaaaacttgtatagatcattcagagagggctatgtcagataagaaactaaaacgtaaattgaaaatacacaaagattgtatagattagaaaataagttcctaccatgtttatttatattttctgctccttcctcaatctggagaaggcactaatctgattcttagagcatagtctttgttgggccacatttaataatgcacatagtctaccctaaaagcaggattctatctccatcctttccattacatttttctgcttaagacattagcggcacccaagtcagcagagcagacaagttttttttttttttctctaaatctacttggctaggtgggtacctccagagcagtggctagtcagactaggacattctttctctgaatggcaccctgaacagaacactaaatagacctattccaatacatgggaagtaaaaacagccagattgcttggtaagacgaagctgcatgatgcatttcaaagttttttcgatacctgcttattgttattgtgatagtacagtaacttattaaaatttaactgctttttgataatatctacagtgtatacagtaccttctaaaatcctgtaaaccaaaaggagcaaatgacagggcagaatttagtgatttctatgtacatgctacgataccatgataataccaaacttcactagcacctcttaaatatatttccttctgatcacaatattaatgccaacgttattatcaaccaaaactcctctctttatgattttaagatcttccatatatgtttttgttttgaacagatgtctgagataattagaactatcatagcagttaaattttcaggcagaacatttctgtaatggactcttgaagagtttaacagattcatttagtagccatccacagttaaggcactttatctaaccttttgtgggatctgggcaagggctgatgcaatcatgttggcactttcttctgacatgttactgatcatcgaccccagagaaaacaccacaataccattttctccagagctctgcacaaactcttccatttcctgtgaagaaagaatttgttctatcagaaaagagcaacagcacagaaaacactattgacaggattgttacaaacatctaagatgagaaagtcagaagctattggagtaatttttttaaactgacctaatcattcagtttctttgaaaggagatgtgtaatataatatatgtgggatctttcatgcaaatttgtgtaaatatgtgtgcatatgcatgtatgtatgtgtgtgtaaggaggaaatgaaacaaagctatgacactgcagtaggaggagataatgctagaaaatgttacacccagacactttatttataatattataattactaacataggttattggaaggtagctttacttggcttcaattctaattttttttgtggttctactaaatctcttgtgtttatttggggtagttttattttattttatttttttctgttcagttcttttagttaggagtcattggagccattacatgactatgagcattgaggaaaagttagttacaattggaatgatattatatctacatttatttagcttctagctctctaaccctttatatttcacttaaagttagggtttcctagtcttaccccactacccctcactgcccccgacacccccaccccccaaaaacaccttaaaagctgaagtataagaatcactgacattcagcagtctggtattgtggtttggaatttctgggaaatagttctgagaattccatttataatacagtattatatactatatagttacataattaagtgatcttatttctcaggtcattgcttaggtatgactatgacaccttttgtcctgaaatcacactgtgaatttgatgtgctatgtataactgaatgtgggggaccctcatcatcactttgctgtgtctcacagggggcacttgaaccacagtgggagaggtcaccaggactttctccagtggagatctgctcaccccctagagtagctccctcacactatatgaagctcctggtgaatatgtgtttgctttgaaatgaatgagaattattctgacttgtgtttcctgatgtgtccctgtttttaaacttaaatccattctctaatgccacatcgctcaatgtattctcacaccaaaaaaaaaaaaagagagagagaaagaggaaaagaaatgtagacccataagtttcctggatatcatatcaaaattgtatactcatctttttgttgctgttgtcccttttgttcaaaattctctttttctcagtaaaataatgaccaaccccttctgtcataacaaatatactttctggtcctaatcattgggggaaatttctttataaaactgtttacaaataaaaaaagaaattctaaaatatgtcaattcagaccatatattggtaagtatttttaaaaaatataatttaactttatgacatcttttttttttttccagatggagtctttctctgtcacccaggctggagtgcaatgatgcaatcttggctcattgcaacctctgcctcccaggttaaagcaattctcctgcctcagtctcctgagtagctgggattacaggcacctgccaccacgcctggctaatttttctgtttttagtagagacaggtttcaccatcttggccagactggtcttgacctcctgaccttgtgatccacccgcctcagcctcccgatgtgctgggattacaggcatgagccactgtgcctggcctgacatcagttttaattggagattcagtgtatggctattagagataattcatgaggcatccaggaactcagtgtaattgcagttgcctgtagccacatttaatgtaacttgagttcaatgttttgtctcattcactgccaaaagtctgcttcacccacccagtattgaagtaataaaacatctatttatagacagatcagcactgatctcattctgtgatgtctttatgaaagtaatggtaatagaagatcaatgtaagtagttttataaaagtatgaaaatttagaaaaagaaaatcatttacccatatctctatctcaatttaaaatgtgtgccatttcattatgggtttaattctatttatataactcaatgtacatatgtgatgtttatttagaaaattttattctcattgtatatgcctttttattctacaaaaaaactgtgatcttgttctactcatcattttgttccttagtttccaactatacctgtaccacggctgacagtgtaattaaacattgttttgaaaaaaggattgtaatggcttggtatgcacattatgtaagtttttaaccatttcttaatgtaagatatttgaattatttccagagtttttttaatgagtatttgctaccgatattgaatcttaccatcatgatttattctctgtacagtttcatgtgagtatattataaaggcaatgcctatatgcatttttcaaacacttgatactttttggcaagagtcttattcttttgaaatatacaaacattatctgagaatctaatacataatggaaaagcaagcaaatttgtcgcaacaattattttgtgtacaaaagaattagagaatcagtttcacaattatttacttggattcaagtctaccttctgcaagttaacaacaacggaggctcacacttgtaatcccagcactttgggaggctgaggcatgtggatcacctgaggtcaggagttcaagaccagcctggccaacatggtgaaactctgtctctactaaaaacacaaagattagtcagatgtgttggcaggtgcctgtaatcccagctactcgggaggctgaggcaggagaatcagatcgcttgaacctggggggtggaggtttcagtgagccgagatcatgctagtatcagtaataatcactattgtactactagtcatttatcccttgtccttattctgctactctcttccccctgctactggcactatcactttcttttaatgtgagtgaggaatttttttttgagaataagataagagtacacagaattaccttttaagctagaatattaatgaagagcctccacctttacaatacaactttagctttccagcttgttcaactgactgcccaaacttaaacatttacatttaaacaagtacacagagtatctgttctctaggactttgctagagaatataatcttgatgtgttggaaaatcaatcactattaaatgaagactgatatcttaaatggctggcacatgttagctaatttaaagtattaaaaataatgactgaaataatcataatatcaacaatatttttggatcactggctgtgtgtcagagacaacttaagtgttttatctgtggtaactactttttttccacacagcacaatatgaagttgtgattattattataaaagtagtcatgattgcttaaactcatgtaaaagttcctaaatgatctttacattttacaaacttgcctttttgcaatattatacattgggaatattgggattttttaaaaggaaatctgatcatatctcttcatttcttaactcttttcactcttttcagtagctctccattgtccctatgggtatatcaaattacatatatatatatatatatattttttttttttgagacagattctcactctgttgcccaggctggagtgcaatagcgtgatctcggctctctgcaacctctgcctccggggttcaagtgattctcctgcctcagcttcccaagtagctgctattacagtcacctgccaacatgcctggctaacttttgtatttttagtagagacggggtttcaccatgctggccactctggtctccaactcctgacctcaggtgatccacctgccttggcctcccaaagtgctgggattacaggtgtaagccaccacgcccggcccatcattgacttttactcaaccttttcctgtaaattaaatttggagttcctgggaactgcccttattgcttttctacttttctgccttaatgcaagcctttactttttttttttttgtttatttgtttgtttttgagacagagtctcgctctgtcgcacaggctagagttcagtggtgtggtctcagctcactgcagcctctgctcccagactcaagcaagcctcctgcctcagcctcttaagtagctacgactatgagactacaggcacacaccagcatgcctggctattattttattttttatttttgttagagatgaggttttaccacgtttcccaggctggtctcaaactcctgagcccaagcaatcatgccttctctgcctcccaaagtgcagggattataggtgtgagccaccttgcctggcctctggttttctttttgggtgtttatcaacccctcatcgtttcacctatctctgcacattattgagtactcactttaattgtcaatgagtttgggatctcttctgcatatttctttatcattgtggtctttccttataacactttttagacttttctttttcacttgtttttattctatctttcaaagtacaatgtaaggcatgagggagcagaaactgtgctacctttattctctgaaaatccagcacttacctgtggtttgtattaatcactctacaaatattttttgaagaaatgaatcatactatcttttgggtggcacaatgaaggccttactttaaccaaccctgttttcaaaatctccctagtaaacctctttggtctttaatgataataacattcacatacttgtgatactacagaaatatatgattttctaatggcaagtccttgtttttgacctcccatattcccctcactctgagttaaacactctgaaagaaacatatccagccattccttctgaaaatgtcaagcaaacaaatgaaacaagaatacatttaccttaggcaggggtttggctggtttacagtgaagtcctccaacaaaatcaacatttggtaagaatgggcgaggaaattcaaaatcccaataggttcgaatgagccacatttcagctttccccattgtctcaaataatgtagtgggtcttcctgatggaaaaaaacaaaacaaaacaaaaggtagctaacacgagaattgttatttgaatatgcaggtattttcctgaaaggacttggaataacatacccaaacatatataaaatgtctgtgcattgataaaatatatataaatacatttatatatagtcataatttagattttatttattgcatatgttgctcatatgtatatataaggaaggcaatgtattcagagatctgtaagaagaaatcacatctttaatgtaacatcagtatattcacaatcataaataattattaaaataagtcactaatatggtttgactgtccccacccaaatctcctctcatcttgaattataatccccataatccccatgtgtccagggagggacccagtggcaggtgattggatcatggtgtggattcctccatgctgttctcatgatattgagtgagctctcatgagatctgatagttttataagtgtctagtatttcccctgcttgcacttctctctcctgccactaagtgagaagatccaagcttgcttccccttagcctttcaccatgattctaagtttcttgaggcatcccagtcatgtagaactgagtctattaaacttcttttctttataaattacccagtctcaggtatttctttacagcagtgtgagaatggactaatgtagccactatgaacttaaatacacatttgtcttccctctgaagctgcaatagtaacaaatatacctttaaacaactctttcagttccacaattaattcatcttaccttacccatgaaaacagctttccaggaagtactctagtgtctacagtttattaagctagtcccttgatccttggttctcaaagtaaaccatgagttttttgagctcaacactgaaatctttacacctactactgtcttggttcatcttaagatcttaatataattagatttttaaaataaatatatttacaaatgagaattaaaacattttcagaatttattgacatagagatatgtgctctcccttaatttggcccctattttctttgatggagagatgcagtttaataaaatatagattaaaacttagatgttcactttcaacaagatttcagtttttgaaagaaataattgtcaacctgttattgaaggaatgtataaacattagaaatctcaagttttaggcttctgtttctggagtagagccactatattactcaactgtgaaggaatccttcttacatgaaaaacaaaatttaatttctaaatgaggaaactgaggaactcaaagagaaacaaattcctcaatcctgcattgataatttttctagaaatatgtgtaaatactaaatttatgtgtctgccttcatgaagatgtttcttgaggtatctattgactttttttaaagatgaaaaaatgtatagcaaaatgatatgtgatagtttaaagaaatcattagtgctttacaatgaaggtttatgactctctgggtgtcctgtagtagtgatggccccagggttctaactgattctataaggtcaacattctataatatttttgagactgatagatcatcttacatttgcaattcataatttcccttaaaaacactatcttctgacattatatttatataagctcaccttcaaaggcacagaaaagttagaacttaataagcaccagttagacacatgacttacctagaacttcactataaaactggtcccacttcttcagatcataaatttgaaaccaaaagtcaaaataaagcatatgtatcatattttttatcctctccatgaaaatcatttgatcacttaattctgacataacaacaggtacataggaaggagggaacagaaatcctccaccattcttctcaaatgtgtagccaacagagaatcgaagactgtacagaaagggtatgttaaatagttcagccagtagctcaccacagggattaagggcatctgccagaatgacatcaaactttgactcttgtagtttcatcataagtttcttattcaaaactgcatctttacagagcttgttactgtagtcataatattcccaacacaattcttgtaattgtgaaaaatatgaccaaaatgtattttttgaaacaccatatatccatctatcgagaattttcagaagagaatcttccaaataatttttagttaaagatgtaggataaacttctaatttaatagcagatgatttactggcattgacaagagtagaagccgaagatgtcaacacagtcacctcatgacccctctgaacaagctcttccaggattgtcttcatatttatccaatggctgtattctgtgggccacactagcacctttccacagcttccagagctaaagtaacaactgagctgtatcagcagaaagactgacgtccatttcagagacatcctggtcttatgcaatgcttcttttccagttgttgtttctttctgtcatttctcatacttatatctgaggaaaaatcaatcaagttaaaatataactgctaaaatttgaagtaaatacataatactaacagtctgaataggtgcatgccaaggagaccaacaaaagattgatgacctcatatttattttagtgtgtttggtgttcttttatgtttacaattactctagtcaagcaataatttttatgacctagaatatgtaagtaacctgtcttatgtaattattttataatactgttaagaacagtggcaagtgagaggctcctgcctgttcggtgcccttgacatagagagaagaagtaattatacaactcaaacggcattttttaatatcgtggtgcaagtaatgtcttctaaaactttgttgacacataattcatataccatatgactcaccaattagtgtgtacagttcaatgtttcctagtatattcacagaattttacatccactacaataatcagtattatctccaaaagattctatacaatagcctctaaccccccactctgaaattttgcatccatcctaccctaggcaaccactaatctaatttctatctctatagattagcattttctggaccctttaaaaaataaatgagggttttccagtgatcatggcagatgggatgcaggactagattgcagctccagacagagcagcatgcagaggcttgcattgtgaattttagctgcagatcaactgcaagaacagaccagcaattctgagaggatccacacaccctctgcaggaagagtactgctcctgcaggacctgggagacatcccaaacactgtgagtgccccaacaatggaagtgggaaagggtgatccccctctccagaatacacatccccactggagaagctgaagttctgtttgcaggagaagttcctgactttatgtgaagctgagtcaaattagagaaccaagccaagcaaaatacaggggtagaggaagtagcagaaaggcactgggagctctctggatacccaagcggctcattcctgcctggcatcacagggatctatcaggagggtggccagtgatgcagggggttcaaagattctcctcaggacctgaaggcttgaagggatgagtaactcctcccttctcaggcccagccccaagatgcaagaccacttgcatcagcagcgtgtgtcagcaagatagcagaagcaggaagagagccggccagaagacacttaccctggctggaagagatgtacccctgaagatcaagaaataggccatccaggtactacatagcagtcacaacagactgggacacttactgtttacagaggactacaaaacccctgtcccatcctcacttggggctgatgccattttaggcctcagcccacctgcaaccaggcgttcattaaaacagcatgttgctccacaccgcctcctgttgtctgttggcgcgctgttggggttcaaactgattcaagaaccttacatctggtgccaaatcctaggaggggctcaggtctgtgtcgcttgtggacctatccctccaccccagagagcaggccacagcaattagacagaggaagctcctcagcctccagtcgcctctctgtgcatgcgcatcagccactgatctcgcctactggtaagtttcccttggagcccggttaacagggcaaaatctacatggcctctcttggtttctccagtccaaaaatccaacactgatccaagaaggcgccagcgtgcgccaggcactcgctggtcatctggtcttagggggatgcctctaagccatttcatcccgttccaggaaccaaaaaggcagcggagacgataactccttttatcgtctccctccagctgtccaggatggtctcctttttccctgttctctcgagctacccttcattatgggaaactcccggtcctcaattccaaaaaacagccctccagcctgcctcattaaaaatctgcaaaccttaggcctcaggcaagatatctgccataagtgccttgtcttttttatacgataaagcctggtcgcagtatgaattagataacgggtccaaatggcccgcaaatggaacactcagctttacagttttaactgacttaagcagttattgcagatgactgggaaaatggggagaaattccttgtgtccaggcctttttgcactcagatcacagcccgacctctgcaattcttgcttacctgttcaaatccttcttcattctcgccgccctcattgcctttatcctcccgaccctacctctttttcctcattggatggagcagactgctgtccacccctcccagaccctacccctccatctcaaccaacttcattaactccccaagcttcctcattgtcttctcagccaccatcttcccagccaccatcttcccagccagcatcacccacttcttttcctataccatcctctcctcaggaaaactctagcattgcctgtactcattctccttccttacagccctctcacggagcctgtaaacccatcccgccaccttacacccgtatctatcctccaatgcctatcaactcaaccccccttccctcttcaaaccctcagcaggaaccccttctggcttcttccttctctcctgcccatactagctccggcaccatctttggcccatgccccacccgtactttagcgccagtgctagaatgcccccttcgggaagtagcaggaactgaaggtattgttagagttcatgttcccttctccctcactgatctctctcaaactaacaaaagactcagttcatttccagaagatcctacctcttatattagggagattcagtaccttactcagtcttatgaactaacctggcatgacagctacttatcttctcttccaccctcaccccagaagaccagcaccgtacttggaccctagctcaggtgcatgctaatacaattcatcatcaagctcctgcccagcctactggcacagaggcagttcccaaccaggacccccactgggattatcaagacagggcctctggacacagccatcaagacctcatgattatgtgtctccttgcaggactcaaaaagggtgcccataaagtggtaaactatgaaaaactttcagaaatcaccgaaggtcctgacaaaaacccagccctttttctctcttgtttaactgaagccatgagaaaattaccaacctggacccagccagcccagaaggaaccactatttcaaaccttcagttcctcacccaatctaccatgatatttggcgcaagcttcagaaggttgatgacggccctcaaaccccacagtgggaccttcttaatttagccttcaaagtctttaacagttgtgatgaggaaagtaaaagaaaaaaacagtttccaatgcttgcctttaccctgcaggcccacagggccacagctccatacagaagcctcctagcaaaacacctccacctggcgcctgtttcaagtgtggcaatgaaggctactggtccaggccatgcccaaacccagctgtgctcaccaggctgtgccccctctgtggaggactcagtgaaagtcaggctgtgagcggctccagcaaggatcgcctccatccctttccgagctggccaaaacctcctactcggatctcaatggccttgccactaaagactgacagtgccctggaacagatgtcccagcaactaccattgcttcatctgagccaagggtaaccctgatggtggcaggtaggcatgcatgttttttaaaaattaatattggagcaacctactctgctttacctaaattttcaggacccacccagtcctcccaagtctctgttgtgggaatcaatggacaagtctccaaaccccaagacccccctccacttttctgctccctgaacaccttttccttcagtcactctttcttagtcctgccttcatgcccagctccgctcctaggcagagatattctttcaaaactccacactactctccacttccacattccccatagtacccaacacatcaacccagacccctccaaggcttctaacaggcttctaaccttcttctactcctccgacctcccaccctgaaacatgcaacttttccttatcccccacctgtagttaaccccactgtttgggatacttccacaccctcggtcacagagcaccacacccccatccacatcacccttaaagagcccaccccgttcctatcacagaagcagtatctcatcccccaagcagctctcataggcctaaagcctatcatttctctcctcctcaccagtcacctactctgcccaacaaactctccttttaacacatcagttctacctgttaaaaagccagatggaacttatcacttagtccaggacctcaggctcattaaccaagctgtactcccagtgtgtccagtagtttctaacccatatactttactttcctcacttccctcgaataccacccacttttctgttctaaacctaaatgatgctttttcacaattcctttacaccctgattcccaaaacctctttgcctttacctgggaaaaccccgacacccacctttcaggtcagctcacctggtgcgtactacctcaaggttttagagacagcccccacctttttggacaggcccttgctagtaacttctgtactttatccctaaaatcatcctctcttctttaatatgttaataatctgctcctgtgtagcccctctcaaagagactgcaacacccatacatactatctcccttttaaacctcttggcagaacaggggtatcaggtctcccctaagaaagcccaaatatgcaccccccagtcacctatctaggcctagctcttacccctgaatgcaagggctcacaacagaccacatactccctccttcagtccctcccgcctccacaaactaagcaagaaattctctcttttccaggattagcaggatattttaagctctgggtttcctccttcgctctacttaccaaaccgttgtaccaagctgctaaaggccctctccatgagcctttaaaacctgcacagcctattacccaacctttccatctactccaaaagtctctcatctcagcccccatcctcactctcccagacttcaccaaacctttctccctctataccgatgaatggcgtggagttgcactaggtgttctaacccagtctaagggacccacccggccaggttgttgcctacctccctaaacagcttgaagccacagttctcggatggcctgcctgcccctgagcattggtggcagttgctgtcctcactcttaaaagcctaaaactatctcttcatgccaacctaacagtttattcaacccataacatcaaagacatgttagctcaccgcagtgtactaagtcttttctctgccccacggctcctccagctgtatgctctattcatagaaactccccacatcaccatgctaaccacctcccatctaaacccggccatgctcttacccgaagctacaaccgcccaagactcttcttcacactcttatgtgtgaatactgttcaaacctttcttataccttttccaaacctaacagaaaaatcccttccagatgcgtcctttactcggtttgtagatggcagctccttcctacatcaaggacaccgacatgctggctatgctatagtgtcaccccccaacactattgaagtcaatctgctcctcttaggcaccacctcccaaaaggctgaactcattgccctcactcgagctctcattctagcatccggaaaacagatcaatatattcaaattctccttatgtgttccacgtagtgcactcacactcatccatctggaaagaacggggtttcctcactgcaaacaatactgtcataagtggctctctcatcagcaagctccttcaagctgccaggctcccacagaaagttgccatcattcattgcaggggccaccaaaccccagacaatcctaaattggctggaaatgtgctagcagatcaggtagccaaacaagtagccctactaccctttcgaggccagttgctgtccttgtccttgttctctcctctttacttctaagaagaaaaagatttccaagcccaaaaccttcaaaagcaaggacgatattatgtcaaggaagggtgcttagttattcctcactctcaaagccttcctcacctccaaagcctccacaactctttccatgttggttaacaacctcttgcagcttctccacgctattctcacttgtcgtcacttttccagccatgttcaagaaattatccagtcctgctctatctgccactcaatgtaaccccagggatccctccagcctctgccttttcatacccaccaagcccagggccagttacctggggaagattggcaagtagacttcactcatatgctgcatgataaatgtctctgctatcttctaatccttgtctgtactttctctggctagggagaagtgttcccaacaacttcaaaaggtgcaaatatcatcacacaaactcatcatgcatacagttccctgtttcagactcccaacatccatccagtccgataacagtcctgccttcatcagccacattacccgaggcatctctacatccttaagaataagtaagttctccacacaccctacacacctcaatcttcaggcaaagttgaaaaaattaactctgtccttaaagcctaactcatcaagccggctctagaaacctgcgagtcatggacaaaaaaatctcccttttgccctcatgagactttgcacaacaccaaaagcaccctctttttttgtttttgtttttgtttttgttttgttttgttttgtttttattatactttaagttttagggtacatgtgcacaacgtgcaggttagttacatatgcatacatgtgccatgttggtgtgctgcacccattaactcgtcatttaacattaggtatatctcctaatgctattcctcccccctccccccaccccataacagtccccagtgtgtgatgttccccttcctgtgtccatgtgttctcattgttcaattcccacctatgagtgagaacatgtggtgtttggttttttgtccttgcaatactttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgcagcaataaacatacatgtgcatgtgtctttatagcagcatgatttatagtcctttgggtatatacccagtaatgggatggctgggtcaagtggtatttctagttctagatccctgaggaatcgccacactgacttccacaatggttgaactagtttacagtcccaccaacagtgtaaaagtgttcctatttctccacatcctccctggcacctgttgtttcctgacttttaatgattgccattctaactggtgtgagatggtatctcattgtggttttgatttgcaattctctgatggccagtgatgatgagcattttttcatgtgtctgttggctgcataaatgtcttcttttgagaagtgtctgttcatatcctttgcccagtttttgatgcggttgtttgtttttttcttgtaaatttgtttgagttcattgtagattctggatattagccctttgtcagatgagtagattgcaaaaatgttctcccattctgtaggttgcctgttcactctgatggtagtttctgttgctgttcagaagctctttagtttaataagatcccatttgccaattttggcttttgttgccgttgcttttggtgttttagacgtgaagtccttgcccatgcctaatgtcctcaaagtattgcctaggttttcttctagggtttctatggttttaggtcaaacatgtaagtctttaatccatcttgaattaatttttgtataaggtgtaaggaagggatccattttcagctttctacatatggctagccagttttcccagcaccatttattaattagggaatcgtttccccatttgtggtttttgttaagtatgtcaaagttcagatggttgtagatatgtggcattatttctgagggctctgttctgttcccttggtctatatctctgttttggtaccagtaccatgctgttttggttactgtagccttgtagtatagtttgaagtcaagtagtgtgatgcctccagctttgttcttttggcttaggattgacttggcaatgtgggctcttttttggttctatatgaactttaaagtagttttttccaattctgtgaagaaagtcattggtagcttgatggggatggcattgaatctataaattaccttgggcagtatggccattttcatgatattgattcttccttcccatgtgcatggaatgttcttctatttgtttgtatcctcttttatttcattgagcagtggtttgttgttctccttgaaaaggtccttcacatcccttgtaatttggattcctaggtattttattctctttgaagcaattgtgaatgggagttcattcatgatttggctctctttttgtctgttattggtgtataagaatgcttgtgatttttacacattgattttgtatcctcagactttggtgaagttgcctatcagcttaaggagattttgggctgagatgatggggttttctagatatacaattatgtcatctgcaaacagggacaatttgacttcctcttttcctaattgaataccctttatttccttctcctgcctgattgccccggccagaacttccaacactatgttgaataggagtggtgagagagggcatccctttcttgtgccaattttcaaagggaattcttccagtttttgcccattcagtatgatattggctctgggttgctcatagatagctcttagtattttgagatacatcccatcaatacctaattcattgagagtttttagcaagaagcgtcgttgaattttgtcaaaggccttttctgcatctattgagataatcatgtggtttttgtcattggttctgtttacatgctggattaagtttattgatttgcatatgtagaaccagctttgcatcccagggatgaagcccacttgatcatggtggataagctttttgatgtgctgctggattcagtttgccagtattttactgaggatttttccattgatgttcatcagggatattggtctaaattctctttttttttgctgtatctctgcgaggcttcagtattgggatgatgctggcctcataaaatgagctagggaggatttcctctttttctattgattggaatagtttcagaaagaacggtaccagctcctccttgtgcctctggtagaattcggctgtgaatccatctggtcctggactttttttggttggtaagctattaattattgcctcaatttcagagcctgttatcagtctattcagagattcaacttcttcctggtttagtcttgtgagggtgtatgtgttgaggaatttatccatttcttccagattttctagtttatttgcatagaggtgtttacagtattatgtgatggtagtttgtatttctctgggattggtggtgatatccccttaatcattttttattgcatctatttgattcttctctcttttcttctttattagtcttgctaacgatgtattaattttgttgatcctttcaaaaaaccagttcctggatttattgattttttgaaaggtttttgtgtctctatttccttcagttctactctgatcttagttatttcttgctgtctgctagcttttgaatgtgtttgctcttgcttctctagctcttttaattgtaatgttagggtgtcaattttagatctttcctgcttcctcttgtggggatgtagtgctataaatttccctcgacacactgctttgaatgtgtcccagagattctggtatgttgtgtctttgttctcgttggtttcaaagaacatctttatttctgccttcatttcgttatgtacccagtagtcattcaggagcaggttgttcagtttacatgtagttgagtggttttgagtgagtttcttaatcctgagttctagtttgattgcactgtggtctgagagacagtttgttataatttctgttcttttacatttgctgaggagagctttacttccaactatgtagtcaattttggaatagatgtggtgtggcgctgaaaagaatgtatattctgttgatttggggtggagagttctgtaaatgtctatcaggtcaccttggtgcagagctgagttcagttcctggatatccttgttaactttctgccttgttgatctgtctaatgtttacagtcaggtgttaaagtctcctattattattgtgtgggagtctaagtctctttgtaggtctctaaggacttgctttatgaatctgggtgcccttgtattgggtgcatatatatttaggatagttagctcttcttgttgaattgatccctttaccattatgtaatggccttctttgtctcttttgatctttgttgttttaaagtctgttttatcagacactaggattccaacccctgcctttttttgttttccatttgctcggtagatcttcctccatccctttattttgagcctatgtgtgtctctgcacgtcagatgggtttcctgaaaacagcacactgatgggtcttgactctttatccaatttgccagtctgtggagtatttaacccatttacatttatttttaaatgtattggagtatttagcccatttacatttaaagttaatattgttatgtgtgaatttgatcctgtcattatgatgttagctggttattttgctcattagttgatgcagtttcttcctagccatgacggtctttacaatttggcatcttttgcagtggctgctactagttgttcctttccatgtttagtgcttccttcaggagctcttttagggcaggcctggtggtgacaaaatctctcagtatttgcttgtctgtaaaggattttatttctccttcacttatgaagcttagtttggcgggatatgaaattctggattgaaaattcttttctttaagaatgttgaatactggcccccactctcttctggcttgtagagtttctgtggagagatctgctgttagtctgatgggcttccctttgtgggtaacccgacctttctctctggctgcccttaacattttttccttcatttcaacattggtgaatctgacaattatgtgtcttggagttgctcttctcgatgagtatctttgtgttgttctctgtatttcccgaatttgaatattggcctgcattgctagattggggaagttctcctggataatatcctgcagagtgttttccaagttacttccattctccccgtcactttcaggttcaccaatcagatgtagatttggtcttttcacagagtcccatatttcttggaggctttgttcatttctttttattattttttctctaaacttctcttctcatttcatttcattcatttgatcttccatcactgataccctttcttccagttgattgaattggctactgatgcttgtgtattcatcaagtagtctcatcctgtggttttcagctccatcaagtcctttaaggacttctctgcactggttgctctagttagccatttgtctaattttttttcaaggtttttaacttctttgccatgggtttgaatttcctcctttagcttggagtagtttgatcatctgaagccttcttctctcaactcatcaaagtcattctccatccagctttgttccatttctggtgaggagctgcattcctttggaggaggagaggtgctctgatttttagaatttccagtttttctactctttttttttccctatctttgtggttttatctacctttggtctttgatgatggtgatgtacagatggggttttggtgtggatgtcctttctgtttgttggttttccttctaacagttaggaccctcagctgcaggtatgttggagtttgctggaggtccgctccagaccctgtttgccttggtatcagcagtggatgctgcagaacagcggatattggtgaacagcaaatgttgctgtctgattgttcctctggaagttttgtctcagaggagtacccggccatgtgaggtgtcagtctgcccctacaggggagtgcctcccatttaggctactcagttgtcagagacccactggaggaggcagtctgtcctttctcagatctgcagctgcatgctgggagaaccaatactctcttcaaggccatcagacagggacacttaagtctgcagaggtttctgcttccttttatttggctatgctttgttcccagaggtggagtctacagaagcaagcaggcatccttgagttgcagttggctccacccagttcgagcttcccagctgctttgtttacctactcaagcctcagcaatgtcaggcacccctcccccagcctcgctgccaccttgcagtttgatctcagactgctgtgctaggtatgagtggggctctgtgggcataggaccctctgagccaggcatgggatgtaatctcctggtgtgccgttcactaagactgttggaaaagcgcagtattatattaagagtgacctgattttccaggtgccatctgtcaccgctttctttgattagaaaagggaattccctgaccccttgcacttcctgggtgaggcaatgcctcaccctgctttggctcatgctcggtgcactgtacccactgtcctgcacccactgtctgacactccccagtgagatgaacctggtacctcagttggaaatgcagaaatcacccatcttctgcatcactcatgctgagagctgtagactggagctgttcctattcggcctagctaattattaatatttcttttcttatagtaattttggttttggtttgttcttgcttttctagtcatttgagatagatcattacattttttatatgaaacctttctccttttcttgtgtaggcatttcttgttctaaacttgtctcttaatagtgcttctgttgaatctcacagattttgctattgcatgatgtgatctttctttgttttaagcaatttcaaaattgtttcttttttatctattggttataaggaatatgttgttaaattttcatggatttttctagttttgtcttggcattgattttataatttatttcattgtgttcagataaaataattagtaaaatttttattttttaaaatttgttgagacttgcttaatgtcctcatatatggttaattctggggatgttatatgtgctataaaaagaatcttacattctgcagctgttggttaaaatgttctgtaaatatcaactacttcaatttggtctatggtacagtttaaatctcatgttgctttattgtctaaatatctgtccaatgctgaaaaggtgatggtgacatcctcaactattattggacttaggtctatctctcctttcaggtataataatatttgcttcatatatctcagcggttcatggttggttgcatatatatttacatttttgtctttttgaacaattgattcatttattatcatattaagtctctcttttcctctcaaaattttggcttaaagtttgtgttttgctgaggtaagtgtagctatttctgcttgatttgggtttctgtttgcatagcatatctatttcatcttttcaattgcagtctatgtgtaactttattggtgagatgagtatcttttaggctgaatattgttgagtcttgttttttaatccatcaatctacgttttcagttgtgtaatttaatccacttattttcaaggtatttatttatttataggtaaaggcttattcttttatttttttctgtttattttgtatctcccttattccttaatttctctattacttattttgacagtttgatagttttctatactgataaagtttgattattttttctttcacctttgtctgttggctgtatgagtgagttatataattttgtgtgtttttatgaagtgtattatcatcttttcaccttcagatgttagacttcctcaaatattccttttaaggctggtttaatggtaataaattctttatgtttttgcttgtttgagaaatactttattcctctgtctctgttttttttgtaggatcaaagtttgctttatataatattcttcattgacatgattataaaacaaattttatcacttagcatatattttcctattctttcctggcctataagttaatgctgagaaatccactattagctgaatggagattcccttatagatgatgtgtcagctttcttctgccatttttagaacacctgctttgcatttgacttgataatttgacgatatgtgcatcagtgaagacctttttggattgaagtaacttggtggaactttcagcttcttggatctagatgttcatcttttgtcaataacttaagaagctttctgctattatttcattgaatataatttctatgctgtttatcttctcattctagaattttcatcatgttaattttttttcttttttacttagtgatgttgcataaattctgtaggattactttattctttttcttctttcttgtctatgtgagtcatttcaaaaacatggtaatagttggaaattatttcctctgctttgtctcttatgttcttgaagctctcaatagtatatttttaaaaaaatttgttcattgctttaaagtattttatatttttgtgggtacatagttggtggatatgcttacggggtacatgagatattttgatccaagcatgttctagtgaaaaatttttacaatgaacaattcaataaagttgcagaacatgaaattaacagacaaaatcaataacatttctatttgcctacaatgagcagctgaaaaagaaatcaaaaaagtattcccatttacaatagtcacaaataaaattgaacatctaggaattaaaggactgaaagatctctataatgaaaactactgatgtaagaaattaacactgatgtaagaaaacactgatgtaagaaattagagggtaccaagaaatgaaaaaatattccatgttcattgattagatgaataaatattgttaacatttctatattaagcaaaacaatctactgatgcaataaaatcatgaaaataccaattacattcttcacagaaatagaaaaaaatctcaaaatgtatatgaaaccggaaaagacccagaatagtcaaaggtatcctaagcaaaagaaaccaacttggagtcacattatctgacttcatattacactacgcacctatagtaaccaaaccagcatgttactgccataaaaacagacacagagatcaatgaaacagaatagagaacccagaaaacaatctacacacctgcagtgaactcattttcatcaaagttgccattaacatacacagaaaaaaagacagtctctttaataaatggtgctgggaaaacagaatatctatatgcagaagaatgaaactagatccctagctctatccatatacaaaaatcaaataaaaatggtttaaaggcttatatctcagacctcaaattatgaactactacaagaaaacattaaagaaaatctccaggatgtttttctgggccaaaatttcttgggttataccccataatcacaggcaaagtaaaaatgaacaaatgagatcacatcaagttaatcagcttctattcagcaaaggaaacaatcaacaagtgaagagacagtccacagaatgggaaaaatatttacaaactatccatctgacaaggaattaataaccagaatatataaggggctcaaaccctctataggaaaagataaaaaaatggacaaagaatttgaatagagatgtttctcaaaagtaaacagaaaagtggcaaacagacatgtgaaaagatgctcaatatcactgatcatcagagaaagtcaaatcacaactaaaatgagacatcttctcacaccatttaaagtagcttatacccaaaagacagacaaaaataaatgctgatggggatgtgaagaaaaaggaaccctatacaattttggtgggagtgaaaattagtaaagaccactatggagaacagttgacggttcctcaaaaaaatgaaaaatagagctaccatatgatccagcaatctcattgctagatatatacccaaaagaaataaatcagtatgtcaaagagatacccgcactcccatgtttgttgcactatttacaatagctaagatttagaattagcgtgaatgtccatcaacaaatgaatgaagaacatgtgttgcatagacacaatggagtaccattcagccatgaaaaagaatgagatccattcattttcaacaacatggatggaactggagctcattgtgctaagtgaaataagccaggcacagaaagacaaacatggtatgttatcacttatttgtgggatctaaaacttaattaaactaatgaacatagaaagtagaaggctgattacttgagcctgggaagggtactgggggcatgggggtaagcagggattttaacaggtacgtaaaaaggaataagacatactatttgatcacacaacagggtgactatagtcaataataacttcactgtacatttttaaataactaaaatagtgtaattatattgtgcataagacaaagtaaaaatgcttgaggggatagatactccattctccataatatgcttatttccaattgcatccctgtatcaaagtatctcatgtactccacaaatatatacatttactaggtaaccacaaaaatttttaaaaattgaaaatttaaaaatttgaaagatatacttaatggaaaaacaagcaatttgtaatacaattattttatgtaataaacaattaggggacaggtttcaaaaactattgacttggatttagtaacaacagtaagtattagcaattatcatgattgtactattagtcattctttcacttgtcctacttccctaccaactcttccgtttcctggtggcactattaatttcccttaatgtacatgggaaaattattaaaatataaagttagattgctttgaatttttattagtatttcatcaacttttatctcacgagaaagttaccatgtagaccttatataatttgcattcaacatggatattatgttttagccattgaataagattttagttgtatgttgatgctaataagaaggtaaacagaaatgatcccctaagagactgtataataatgttgcaaagaataattgctatctatatatatcttaaaagtgtgatattaatttaaaacacatgagattcttgtgttctctcataaggaatattctatagaataaataattgttattatgaactaagggcacttttcagatacaagtggtagaaattatttggtttttattaggcaagcacttttcatttttttcttggattctctgagatgcaggtatgacgttgagacataagttgccccagggagctttcctgagttgtcctgcaggcttggcataaggtggaaaaacacctgttcttatagggtaaaatgacctttttttgctgtaacatgtagacctctggaatctcagggatgaatggtttaaatgctggagtgaaagcaagtaaacactgggttttgttgcaaatattttgggggcacaatttctttttatgttgaagaatggtgtacattttaagctagaatactggtgaagagccccaatccttacaatacatcattagcatttcaccttgctcatctgtttgcaaaaacttctgcttctgcttttaaacaagtccacaggatatctgtcatctataacattgctagagaatgtaatgttgatgtgctagatgataatcagtatctattaaatgaggaatgatatctcaggtgactggcatatgataggtaattaatgttattggaaataacaaaaataaccaaaattgcaatattaatatttctggatcactgacttagtgccagacacattttaagtgttttacctgctttaacttttttccacaatacaatataaagctggcaaaagtacacataaatatctctatcaacatgctggtatatttttctatcatttgctgcctgattttattaaaaaaattctaaattgtgtattctttttattctgaccctctgcagtctaattcattgaatatcttggaaactttttaaaggaaggaaatataatcagatctctccatttgttaactctttttagtagcttcccaatgccataataaatatttcaagatcctaataattatttggctccaacttgcctcttcagaatcatctgtttcttagtattcttctgcaaactaaacttgaagacttgagaactgtctttactactttgcctgcttttccttttgtgtcttcctctccccctcattcatcacctatttcttcacacctttcagttctcatcttgattatccatgtctccagtatactttctgttatcccaactggatatatccttgttattgtggtactgaagataatgcttttcacacattttattacttgcttatattttatctttcaacatagagtttaaggaatgtggggacagaaactatgtctacttttcttgtcttcttaaaatccaaagcagtggtttgtgtgaagcactttataagaagtattgtttggttgaataactaatactttcttatatgttgcaaaatgaaggctttaatttgaacattactaggttcagatagtctctagtagtactcttttttctgtagtaataatgaaattcatataattgtgatgatatagaaataggaatctttaattggcatctggtttaccccacccactaaacatctttctttcacttcaagcaaaaacactgaaagaagaatatagtatcattcccaccaaaaatttaagacaaacaaaacaaaacaaaacaaaacaaacaggtttttttttttttttttttttttttttttttacctttggcagggattttgcaggtttgccgtgaagttttccaacaaagtgaacattttgtaagtgtgggtgaggaaattaaaaattcctgtagttttgaagaagctttgtttcacttttctccattatctcagataatgtagtattttttcataatgggaaaaaggaaaacaaaggcatatgacacaagataattgttatgagaatacaactgataattatctgaaaggagttagaataatgtagccaaagatatataaattgtctatgcttagataaaacaatatacatgtatttatacctggggataatttagtttttgtgcattatctattttgctcatatgtatttacaagaaagaccaagtgctaagagaattgtgggagaaaacttattcttctatcacatcagtgtattcgccatcgtaaaccataattaaaataaaccttagagaataaaacatgcatttgtttactctataaagcagcaatagtaatagatatacacttaaaacaagtctttgaggtccatgatcaatggattctactctactcataaaaaacaattttctaagaagtactcaatttttttcaaaaattaagctagtcccttgatcttttgttcttcaagtgaactgttgagtattttgtgagtatggctgaaatccttgtacctactactgctttgggttcatgctaaggtcttaataatgttagattttaagtaaacatattgtcaaatagcagctgaaattttttcagaaattattgaaatagagacttttgcctaacatggatttcactcatattgttcttagtgaagagacatagttaaaaaaaaaactatacagaagtaacttgatgttcacatttcaacagatgtttgactttaagacaaatgattttcaatcctttagtgaaggagtataaagatactagaaacttcaaattacctgcattgatttttgagtctttgatagagaaattgtatcgttcaattgtgaaggaaacattatggtactgtgggaaaatattttaatttctaaataagggacctgagatacacaattcaaaacaatcccctcaatgctaactagatagttgtgctagaaaaatgcataactcctcaatctacatgtctgcattcagcaggatgtttcttgatgtgtctaatgacttttcttaaatgaaaaatatgtcaagtaaaatggatgtgtgattgctgaaagaaatcctaatgacattaatttataggtttatgagttcctggagtgtgctgtattagtgatgaccacagggttctaacagatgctataatgtaagtctttccataatatttgtgagattgatagattattttatattttcatttcctcatttcttttattgaaaaacagtacttctctgactttatacgtacttaccttctgttttagttaattttcacactgttgacaaagacatactcaagatgggataaaaagaagtttgaaggactcacagttccacgtggctgggaaggcatcacaatcatggtggaatgcaaagagcaagccacgtcttacatggatggcagcaggcaaagagagagaacttgtgcagggaaactaccccttataaaaccatcagctattgtcagacttattcactatcatgagaacagcacaggaaagacctgcctccatgattcaattacctcttactaggaccctctcacagcacatgggaatacaagatgagatgtgggtggggacacagtcaagccatgtcattctgcccctggcccctcccaaatctcatgtccccacatttcaaaaccaatcatgccttacagacagtcctccaaagtcttaactaatttcagtattaactcagaggtccacagcccaaagtctcatctgagatgagacaagtgtcttctgcctatgaacctgtagaatcaaaagcaagttagttaattcccagatacaatgagggtaccagcattggataaatacagatatttcaaatgggagaaattggctaaaatgaaggggctacaggccccatgcatgccagaaatccaacagggcagtcattaagccttaaaattacaaaatgatcttttttgacttcatgtctcacatccaggtcacactgatgcaagaggtgggtttccatggccttgggcagctccacacctgtggctttgcagggtgcagcctccctcccagctgctttaaagggctggcattgagtgtctttagcttttccaggtgcatggtgcaagttgttggtggatctaccactcaggtgtctggaggatggtggcccttttctcacagctcctttaggcagtgtctgagaagcaactcagtgggagttccaactccacattttccttcttgaagtccctaggctacacagaatactgggacgatttttttctttctagcccaccaggcctgtgatggaaggggctgccgtgaaggcctgacatgctctgaagacatttcccccattgtcttggtgattaacatttggctcctcattacttatgcaaatttctgcagccagcttgaatttttcctcagaagaagttaactcttatggtttaatgtaaacacagtatattaaaagtctaagtatgtgcatggcaaagagacaaacaacttgctctttacttgagtctttaatgtcccttttatgtttgtaaatgctattatccaggtagtatcaataattttgtgtggatgagtcacttattttatgtaatatattttacaatagtgtcaagaacattcacagtgagaagttcctttagttctgcaatcactttgagatggaattaaagatgaaaataattatatgagtatatcagcatttcttggatattgtgcttcaaggaattttttggtaaaagttgacatataattgctatgctatacaatttactgattattttgtaaaatccattatttgtggtatattcacagaattgtacatccatgacaacaatcagtttcagagcacttttatttgtatcacaaaataaaccctgtactctttagtattttttcctcaccctgagtttctgcatttctcctgccctgctcaattgctaattaaatttgtatctatagatttgcctattctggaaattttaaaataaatataatcgtacaatatatagtttcttgtgactggcttccttcatttagcataacattttaaaggttcatttatgatgtagcatatgtaaggacttcattcctttttaatggcaaaataaacattttatatatgagcatacacattttatcgatttatttatcagttgatggacattaatttttccctatttttggctagtatgaataatgatgcttatgaacaagcttagtgtaactgtgttttcatttctgtcagatacatattcttagaagtagaattgctgtgttgtgtttccttgcatgtttagctataaaaggttaaactgtacgtgtaaacttttgagaaattgctagactgttttccaatgtggttgcaccattttccattcccatcagcaatgtgtaagtgttacaatgtctccacatcgttttcaacaaatgattatgtgtctttttattacagctaggctggtgggttgaagtagtgtcttgtggggaaaagaaagagagatcagactgttactgtgtctatgtagaaagaagtagacataagagactccattttgttctgtactaagaaaaaatcttctgccttgagatgcagttaatcgataacactagccccaaccctgtgctggcagagacacgtgctgtgttgactcaaggtttaatggatttagggctatgcagtatgtgctttgttaaacaagtgcttgaaggcaatatgtttgttagaagtcatcaccactctctaatctcaagtacccaggcacacaatacactgcggaaggccacagggacctctgcttaggaaagccaggtattgtaaaaggtttctccccatgcgatagcctgagatatggcctcgtgggaagggaaagacctgaccgtcccccagcccaacacccgtaaagggtctgtgctgaggaggattagtaaaagaggaaggcctctttgcagttgagataagaggaagtcatctgtctcctgctaatccctgggcaatggaatgtctcattgtaaaacccgattgcatgttccatttactaagataggagaaaaccaccttagggctggaggtaagacatgctggtgacaatactgctctttaatgcaccgagatgtttatgtatgtgcacatcaaagcacagcaccttttcttaaccttgtttatgacacagagacatttgttcacatgttttcctgctgaccctctccccactataaccctattgtcctgccacatccccctctcgagatagtagagataatgatcaaaaaatactgagggaactcagagaccagtgccagtgtgggtcctctgtatgctaagtgccggtccccagggcccacttttctttctctatactttgtctctctgtctctttcttttctcagtctcttggcccacctgacaagaaacacccacaggtgtggaggggctggcccccttcagtatctcattgttgattatatttccttggtgtctaatgatgttgaacattttgactttgcttataagccactgtattttttttcttttttggagaaatttctattcacatccattgcccatttttaattaatttctttttcttattaagttgtaagtcgtatttctgatacaagtacttcattagttatatcatttgaaaatagattctaagattatgtgggcttttgttttcttgatgctgtcctttgaagcacaaaagtactaaatttgataaagacctatttatatatttttcatatttgattgcttatgcttttgatgtcatatgtaagaaaccactgccaaattcaaagccatgaagattatcttctgtgtgttctttttggaattttatgattctacctcttaaatttaagcctttgacctacttttagtagttttgtaaatggcttgagaccagaagtcaaactttattcttttgtttgtgggcaatccgttattcaataagcatttgttcaagactgttcaattttttcattgaattgttttggcatctttgtaaaaaaccataaatatgtgggtatgtttctgggttctaaaatctattttgtttgtatatatgtctatttgtatgcctataccaggctcatttgattattatagatttgtagttggctttgaaagaagaaagtgtaaatcttccaactttgttattattattattattattttcagacaggatcttactctgtttcccaggctgaagtagagtggtgtgatcatggctcactgcagccttgaactcccaggctcaagcaatcctatcaccttagcctactgagttgctaggaccacaggcatgtgtcacctctcctggctaatatattattattagtattataaagacaagagtctccttatgttgcccaggctggtcttaaactcctttgctcaagtgatctacctgccttggcatcacaaagtacaactttgttctttattttaagacttttttggctatctttaggtttcttgaatatctttgtgaatttcagaattagtttgtcaatttactggaagaagccagttgggattttgatagggattgcattaaatctgtatatctatttggggagtggagtatggacactacaacaatactgtgttttaatctgtgaacatgagatgtctttccatttatttacatcttttaaatttctttcctctatgctttacagtatccataatgcaagttttacacttattttgttaaaattgattcctaatagttatattcttttggatgttatttgaagtgcaattgttttcttaatttcattttggatatttcattgcaattatgtaaagtaatttttttgtttattgatcttttatcctgaaaatttgctttgtttattgttccaatattttttctagcagattcctaaagattttctagatgtaaggtcatgtcatatgccaaaagtttaacttctttcttttcaatgtagatttatttttttcattttcttgcctttatcttgactagaagctccattaaaatattcaatatagataaagagtggatttagtctttctccattaagtatgatgttagctgtgcattttttacagataacacttaccagtttgagaaagtttccctctatccctactttacggggtactgttataatgaaggatattgaattttattaaattaatttttctgcatttattgagatgatcatgcagttttatttttctgttctaattacattttgtattatgttaatagagattttaacgttaaagcaactttgcatttttaataaaacttttacttattcagggtatataattgcttctgtatattcttacattcattttgctagcaaattttgtggatttctgagttcataatcataagatttatcgatctgtagtttttattttttgtgatatctttgtgtggttttactagaaggaattagttaaatatgttgataatgcatttttcttttctgtgatttgaaggattatttttgaggaattgttaatttttctgctttaaatgacttatagatttcaaaataaaggcatcttgacctaggcaattctttgtgggttgtattttggaccaattcagcctctctttttgttataggtctattcagatgttctgtttctttttgaatcagtttaatatattttcttgtctgtgtcttcctgtagtagaatttatgtcaaattaagttgggagtgggtgagggagcagttcatggttgaaattaataggctctcattatttttaccaggacttagtagattttcttgaataaatattgctaatattacgctttataattttaggtcaatgcctggacactttaattttttatagaaaacacaatattttaatgctaaagatgtgtttaaattgtttcttttttacaattgtgatgttctatgaagatttaaacttttgactgttaacagatgatttaaatagaaatgtagcatatgtactcagtgtacatgtgtatattcagcttgtcagcattgagttatctttcataaacttatatttatttatttgacacaaccaggtgggaggggttcccagagaaacaccagagagcctgtgcactgggaggagtgcacactggggtggagccacagaagttcatatgatttgcagtgaggaggagcccggcccctcctcttcttggatggaacctggaattcagtctgtgaggtggcaaacccaccggcaggaaaacacactctctcacttcactaagagcctctgttttgccttttcttcctttttacctaacaaaactctgcattattcaccttcaaagtccgtgtgcctaatttttcatggccatgtgacaagaaccttgcttttagttgaactaagaaaaagtcccacaacatatagatacacacacacgcacacacacacacaggcaaaaatgcaaaaacattcctcattttattttgttttacagatatggtcttttttacaaattgaaagcttattgctgccctgcattgggcaagtttaccagtgccatctttccaacaggatgtgctaactctgtcactgtggcacattttggtaaatttcacaaagttccaaacatttttattattattatatttattatgatgagttgtgataactgattgttgattttactgtagtattgtgttgcgggcaccagaaactgtattgggataatacgataaacttaactgataagtgctggtgtcttctgactgctctaccaaccagcctttcccccatttctctctctctccttaggcctctctatttcccgaggcacagcaatgttgaaatcaggcaaattagtaatcctacaaatggcctctaaatgttcaagggaaaggaaggctctgtcatctcaatatcaaaagctggaaatgattaaacttattaagaaaggcatgttgaaagctgatacaggctcagatctgtacctcttatgccaaatagttagccaagttgtgaatataaaaaaaaaatttgggaaagacattaaaagtgctacacatgtacacatgaatgatatgaaagtgcaacagccttgttggctggataaaagatcaaaccagtgacaatagtccccaaatttagacaaagcctaaaccagaacaaggccataattctctccaatgctgacaggggtgaagaagaaatctttgaatctagcagtggttggttcacgaagtttaagggaataaaccatctccataacataaaagtgcaaaataaaagaagctacagaagattatccagaagatgtagccaaaatagttactgaaagtggccacactaaacaggagatttttccttgtgtacagagcatctttctcttgaaagaagataacatttagcttttttatatcttcacaggagaagtcaatgtctagcttcaatgcttcaaaggacaggatgactctttcattagaggctaatgcagctggtggcttgaagttgaagccaattttttttttttttttagatggagtcttgctctgtcacccaggctggagtgcagtggcaccatctcagttcagtgcaagctccacctcccaggttcatgccattctcctgcctcagcctcccgagtagctgagactacaggcaaccgccaccacgcctggctaattttttgtatttttagtagagacggggtttcactgtggtcttgatctcctgacttcatgatccacccacctcggcctcccaaagtggtgggattacaggcatgagccaccgcacccggttgaagtcactgtttatttaccatttggaatatcctagggccttagataaattattctaaatctactctctctgtgctctattaatggaatatcaaagcttggttgataacacatttctttacagcataaattactaaatattttaatcccactgttgagatctattgaccagaaagaaatattcctttagaaatattagcattcattgacaatgtacctggtcacccaagagctcttatggagatatacagggagatcaatgttgtttttatgcctggtaatacaacattcattctgtaacacatatatcaaaaagtaatttcaacttttaagtcaattaaggaataagtttcgtaagattattgctgccattaacagcaatttctctgttggacgttgtcaaagtaaattcaacactttctggaaaagtttcacctttctagatgatattaagaacatttgagtcattaaatgaagtaaacatatcaacattaacaggaatttggcagaatttgatttcaaatatcatagataatgttgagagcttcaagaattcaatggaagaagtaaccacagatatggtagaaatagtaagggaactattactggaattaaaagaagaacctgaagttgtgactgaattgctataatctcatgataaaacttgaatagatgagttctttcttatggatcagcaaaaaaatttggtatagtgagatagaacctactcctggtgaagatgctgtgaacattgttgaaatgacaacaaagtatttagaatattacttaaggttatttgataaagcagcagtagggtttaagtggattgattccaactttaaaagaagttctatcatgagtaaaatgctaccaaattgcattgcatgctgcagataaatccaagtcaaaatcacaatgagatgctaactcaagccagtcagaatggctatttttaataagtcaaaaacaacagatgctggtgagattgtggagaaaaaggaacacttttacactgttggtgagagtttaaatttgttcaaccattgtgaaagacagtgtggtgattcctgaaagacctagaggcagaaatataatttttcccagcaatcccattactaggtgtatacccaaagtaacataaattgttctattataaagacacatgcatgcatatgttcgttgtggcaatattcacaatagcaaagacatggactcaacctaaatgcccatcaatgacagactggacaaagaaaatgtggtacatattctccttggaatactatgcatccctaaaaaagaatgagatcatatcctttgcagggacatggttggagttggaggctgttattcatagcaaaataatgcagaaacagataaccaaataccacatgtcctaacttatatgtgatagctaaataatgagaagatatggatacatggggggtaaaaacacacagtggggacttttggaggtcaggggatgcgaggagggagaggatcagaaagaatagctaatggattctaggcttaatacctgggtaatgggatgatctgtgcagcaaaccacgatggcacacgtttaccttgtaacaaacctggacatcctgcacatgtaccttgaactttaaataaaagttggaaatttttaaagaaggaaggtcaatgggtgcagcaaacattatttttgtctttttaaaagacattgccacagctccccaaactttcagcagccaccaccctgattagttagcagctgtcatcatcaatgcaagaccctccacctacaaaatgattacaactcactgcaggctcagatgattgttaggatttttaaagcaatgaagtattttcattacagtgtgtacattatttgtaacatatttatattgcagacttaagagactacagtatagtgtacacataacatctatatgccatggaaaaccagaaaattttgtttgacttactttacttcagtgttctgggaccaaatctgcaatatcttggaagtatgtcttgtataagtgaaaataaaatgagatctactcttttaaaagtattttaagtgtatgatacattattgttaactatggccacaatgttgtgcagcagtgctctgaaacctgctcatcttatttttactggaactttatactcattgaaaagcaactctcaatttcctccattctccagccactggtaacctccattctactctccgtttctttgagtttgactgtttcaaatttcttacacaagtagaatcatagagtatgtgtcccattgagactggcttatttcacttaaaattatttcctgaaggttcatctatgttgttacatattgcaggatgggtggatcatatggaagttctatttttaattttttgagcaacctctacactgttttcattttggctgtaaaaatttatattcacactgacagtgtatgaaagtttcaatttctccatttcctagccaacaacttttattgtgtgtgtatatatgtatgtgtgtgtttgtgtctgtatgttgataaagacatggtaagaggtatgaggtgatatctcattgcagttttgattttcctgatgatgaatttacattaattagttttcatacagctgttgtccatatgtacaacttcctcagagaaatgtctttttcaagtatttgcctatttattaatcatggctttttttctctttttgctattgagttgttgcagttcctaatatattttaggtgttaacctctcatgagatatatgatttgaaactgtttcccattcccattttatcttttcactctgttgacttctttgccctgcagaaactttttagtttgatacaattctactttcatatatttgaccttgttacctgtacttctgaggtcatacccaatagaccattgcccagcccaatgtcataaaactttttccgtgttttattgtgagagttttatagtttcagggcttatgtttaagtctttcatttgttttgtgttgatttttgtatatgacataaactaagggtccaattttattcttttgcatgtggacatctggtgttctcatgcagtaccgtttcttgaagagagtgacatttattgagtatatttgagactcattgaatataagtgcattgtatatttgtgactttatcatctgggctctctattctgttacttaaatctctctctatttatgtctttatgtgaatatcatgttattttaataactgtagcttttaatatattttgaaataaggagatgtgatgccctataactgtgttttacttttcccacattgttttggctagttacttcttcctggatcattatacattttaagatttttttgtctttgtataagtcattggtgtttcgatagagattacatttaatatgttaatcactttaggttgtatagatgtttctgtaacattaaatcttccggtcaatatactatgtctttctaaattagtataatctttaatttcattcatcagtgttttgtagtttttagtatacatgtctttcttccacttgttacagtttattcttatgtattttgtcctttttgaggccattgcaaattggagtgttttgttaatttccttttctgatagttctttgttaatacacagaaaggtaagtgatttttgtatgctgattttatatgctgcaaatttactgaatttatgcacttgttctaataatatttggtggcatctttagggttttccacatataatatcatgtcctctgcaaacagaggttattttactgttgattcagaagcctgttgctttttttctttttcttgcctaattgttccggctaggatttccagtatggtgtataatagaagcagcaagagtgaacatcctttccttattgtgaaaacagatgaaaagttttcagtttttttttaatcattgagtatgatgttagctatgagcttttcatatattgcctttatcaggttaagataatttccttctatttcttgttgcaggaagtcagggaccctgaatggagggactggctggagctgaggcagaacatcataaattgtgaagatttcatggacatttatctgttccaaaaattaatacttttataatttcttatgcctgtctttactgcaatctctgaacataaattgtgaagatttcatggacatttatcacttccctaataatactattataatttcttacgcttgtctttactttaatctcttagtcctgttgtcttcataagttgagaatgtatgtcacctcaggaccactattgtacaaattggttgtagaacatgtgtgtttgaacaatatgacatctgtttgtaaaacatatatgtttgaacaatatgaaatcagtgtaccctgaaaaacaacagaataacagcaattttcagggaacaagggaagataaccataaggtctgactgcctgaggggttgggcagaataagccatatgtttcttcttgcagaaagcctataaatggatgtgcaaggaggagaaataccgctgaattcttttcccagcaaggagtaaccctggggaaggaatgcattcctggggagaggtctatgaatggccactctgggagtgtctgtcttatgcggttgagaaaaggactgaaatatgccctggtctcctgcagtaccctcaggcttactaggattgggaaattccagcctggtaaattctagctagactagttctctgctctcaaaccctgtttcctgttaagatgtttataaaaacaatatgggaacagcaggacatagagcctcatcagtaattctaattctgcctttgccttgtgatctatatggccctttgaagcatgtgatccttgtgacctactccctgtttatacaccccctcctcttttaaaatccctaataaaaacttgctggttttgcagctcagggtcgtctgcacagtcctaccaatatgcgatgtcaaccctggaggcccagctgtaaaatttctctctttttactcttactctttatttctcagaccagtcaccaattagggaaaatagaaaagacctacattgaaatattgggggcttgttcccccgatatcatttctatttctagtttgtttagagctctcttttaaaaactcataaacaattgatttttttcaaatgctttgttttgcatttactgatatatcaagtgatttttatgcatcattgggttaaggtgatatgtcacatttgctcatttttgtgtgttctattatccttaaatctagggataaatttgtcatttcttttaggaaagaagcaatgctgagtcttgaacatagtaaaagccaagcaacactactggtcttgtaatatcaaaaggaagagtgagactttcttcacaatttaattattgagtagtttctttgcaacagtaaaaacaacaaaattctgctgaaaatgaaaccaaagaattctgagtatttgaaaaatggtattaatattgtgaacggatgtcttaatattgggtcaatgtataaagtgtgaaacacagctcagtaatttttgtgcatgtgccacttgtgaatagaataatgtatttcacataaacccatatggttttacattattttttatttttccttgtttttaagtatttgactaagaatatttctaacttttaaataggtactaaatctctggaaaataaattttgacctaacagtgtaagttataaaaatatgttttgtcacaggaggaaggaaatcctctgtatcaacctcttcatgctggaattaactgaaggaattctatcttttggtcattccagcttcaagccttttatgtaactaatcccttttctccttctttcctgttttagcaaactttcagaaagaaaacaggcaacatcttgtgatgatgaagatcacagttgacacataggccagcaggaacctaatcacatgcaagttgtggtattggaaccaggtgaggtcgtgggctgcaacccgaaggtgcttggctcctttgtgctgcatgacaaactcaatccagaaggctgcttgatccaggggcttaattggcaaatcatggcgaattattgataacttcatagcattctctttgtagctgaaggataaacataaaaataccaacattgaaagtaaatttatttcctaagtctatggatggtctttgaaaagtgtcacatcaatgcttcaaagtaaatattatagaattgtcataggaatcgaatgttttggtttggacaaatgtagaaagtttattttttaaaatggaattttataaagaaaaatatgtcttaaattaaaaatggaaggtctgatgagaaagttaatgtctttgtagcagaggaaatattttgagccattctatgtgctacaggtaagacagtggaaatgcaatctgagattgatcatcttgatattttattttatttttttttgagaaagagtctttctctacggcccagattggagtgcagtggcatgattatgggtcacagcagcctccacagtgtgggcttaaacaatcctcccacctctgcctcctgagtagctgggactgcaggcatgcaccactttgcccagtaatttttaaatatttttttgtagagatggagtcctaccagtttgcccaggatggtttcaaactcttgggctcaagtgatccttttgctttagccttccaaatttctgggactacaggtgtgaactacctttatcgacccattttgatatttttaaggaaaaattgtttcacagctggtgtaatatttctaaattagtctttctctttctaccctactattctgtgttctaccatattttcctctcagtagtcagaataattttttgaaataaaagccagattatggcattcctctgataagattttcacctggcttctcactatattaagaataaaatctaaatctgtctttgttctacagaaccctacatggtcaggcatgggcaacttcttctaacactttccccaaccaccttctctcctagaggcattgcccttctattgttctttgagctccccaatgtgttctcacctgagcccctttacaccctttatcccctctctccctctcttggaatattcctccttgcaacaacttgaggcttgcttctatatctttttgaggcttccccttaaataatacctgttaaagaggcttttcgtggccacactatggtagtacctgtaggatttcctctattgttttgtgcttattttgctgtttaactcctggaacttaaaaatatgttacatgtcttctcaaataaaactttaagtataaaatacataaatgtacacaaattcagtgaatagctcaaaattttaacattaccttgaacaatatcctgatgtgaacaccaacttacctactacgcagattataatataagacatcacaacctgcctagaaaaactctgtcttcttgggccattttagtcactacttttgtcctcaagttaaaactaccttgacttctaatagattaatattgcttgtttacataatgaattatataatatatactcatttgtgtctttttttgggtagaagttattggctaattccattgctgtaatatgattcagtcaattgacaaataccacagattatctcctatttttatgactgatggatatttgggttgttaagatttttgaacactattactaattctggggtaagcaaatgtgtgtatatcattagatatacatattaatacatttttgatgggtatatacttgagagatgagttgctgagaaaaagatgcatgtagaattatgatgttttgttgactagctttttaaatacacaaatttaatttccaaaatttagagttgttttttaagttataattttttggataatttcgaatttatttctagtatggctagagcatttcctttttatgcttttgaatcttatcacatttgctaagtcctgatttttggcccagcagaagttcaattcactaactattccatatactcttaataaacgtatattctcaatatacattcacactcacctccacacctccacacataaaaatgtgtgtgtatatatatatatatacacacatatacacaaacttactatatatatacacaatacatatatatgtatacacacacatatatacaataggttatatttatgctcttcaaatgtttatttttaagtcacttttttttctctgtttaaatttagtatgagttctagtagattcacttttaaatctactatcttattctgtattttattttctgttttccaatctgctgtatgtttcttttctaattctttcctgtttgcttttaaactatttttaatcattcactgtcttattatcttcctggtaaggtattttcagtatattttctaagatggtacctccttatatatattgacaatagtaatcaatagtcacagcattttctacattatttcttttggagcacagaaaaattattacagatttattttctcaatattaaaactttgtgcttcaagggacatcttcaataaagtaaaaaaaaagaatcaacctataaagagtgggagaaaatatttaaaaatcatagactgacaaggcattccaccaataatataaaaataattcttatgaatcaataataagataaaaatgttagaaatgttcaaaagataggaataaaattttctcaaaagaagacgaatgacttgccagtaagtgcatgaaaagatggttatgtctttagccacaaggaaaatgcaaattaaatccacaatgaaagatcattttatatccactgggatccctgtaacaaaaagataggagataacaagtgtagggaagagcatgaagaaattggaaccctcctgtacagctagaagtaacgaaaaacggtgcaagtactttgaaaaacagtttagcagttcttcataaacatcaactttccatatggctcagaaattccactcctagtatcttctcaaaattagtgaaaacaacttttttcacaaaaaatatgtatagcagtgtttataagagctaaaattggaaataactgaaatgtctgaaagctgataaatgggtaaattcaaaatggtacattcatcaaagaatattagcaataaaaagaaaaaatgttctgacactttcaacaatatgggtgaaactaataaaagacattgtactaagtcaaagaaatcatttatagaacactgtaaattgtatgatttaatttacatgaaatatccagagagaataatctattgagaaagtaagttgatatttccctaggactggaggtttatcaacagtgattttatgcattttgaggtttattttagggtgataaaaatgttcaaaaattatattatggtgatggctttgtaactatgtaaatgtactaactacttttagatctcacttttaaataggtaaatattatgctatgcaaattgtatcttaaaataatgataatactaaaaatacattattgagcatgaatacagttatactttcagaaattttatgtattgaattgaaatactttattttatttctccaagttcattatttcattgtattataatccatcattcaaaaaacttatattttaaacaattatctatatatgtttaaaaatatttgtgtgtagaaggttgttacagtaattggtgacccattaaatatatgggatcaaatgtaactaaaataattggtgaaaaataaaagcaggtttcaagttggttaaattatttaaattctttcaaaattggtctcctaaaaggggtaagacatgtattcagtgttgtcaaaagaatctgtaaataccacatagtaaaaaaaattgtcatactcacacagggtcattaatgactgtcttcagtgcattgagcaaatctgtacttgacatggtcctgatgtccacattgagggccttcatgtgagcaatgttatcaggttgatctgcaaacaaaggaatgcccaccatagggatcccatggtagattgcctcatagatgccactggtttcaccatgagtcataaaagatttagtttttggatgacctaggattggataaattttagcaaaattattcataagactaaaatgagaaatgcacaatagaatgctctgaaaggggcagtgtctactaaataacagattattatacacatcaaactccattagaattgctttcggatttcagagaaagaagcacctaattcttctggaggtaagtgaaggctacatgaagaggtgggggcgtgtgtgacttcagactcaaaaaatgaattgatattgccaggtggacaaaatgaaaaagcacattctgaatgaaaaaaatgtgcaaaaaaaaagagaaaagaaaatcaataatattgtgtatgttagagcattttcccttaaatacatactgcggtctgagtgggatatgtggtgtatgcaaggcaacagggagtgtggtggtggtattggaatagaagaaaggcaggccacattacatcaggaaacgtgttatcactttatgataaagattgaggatttaggccgggtgcggaggctcatgcctataatcccagcactttgagaggcagaggtgggtggatcacctgaggtcaggagttcgagaccagcctggccaacatggtgaaacctggtctctactaaaaatacaaaaattagagaggcttggtggcaggtgcctgtaatcccagctactcgggaagctgaggcaggagaatcgcttgaacctgggaggtgaaggttgcagtgagccaaggtcatgccaatgcactccagcctggggacaagagtgagacttcatctcaaaaaaaaaaaaagattgaggatttattttcagaaaatgcagagttattggtaataaaagaggcactgttattttttagtgtcttttgaaattaaccctgaagtagggaaaaggacaggtgtaaagctgtacaaataggagacagagagacaatccaggaagttattgggaaaccccgtgagaggtaattatatctgaaataaagataatttgattctgaacataaagaatgtgagtgtctataataaaataccaactatatagttattttcctggtaagactggaaaataaatataaagtagttagcctttatatttgagttttttgataataaatgttccgtaagtttctttcaggttgaactatccttctaattagctgttagtcatatattcagtatttgttctgcagagtattaccaagaaggtcattctgggatatccacttgtacagctgagtattggatgctaaagtatttggtctctttccatccacagaacctgttggggtaaagaaaatatcttgttccatgagtagaatgccaaagctataagatgttagaactctaaagaaattgtcaatcaactagttaaaccccttccatataatagatgaaaaaacgagaacaagcaattttaggaaatgagtactactaaaagactattgaatatccacatttcatgtcttttattatcaatttggtatattagaaaatcatgatgttttcaacagagaagcttagacacttgagagtatcaataaaaaattcaaaaatttaagaaattattagacagtcattataattctactgtaaaatacagtaacaaattagtgacaacctatacatttattttatgtattttatactacctgtaatcttccaaatttaatgttagtttatttcttgagtgaaatgagaagtgttacttatatatatttttctgtaagttattttgttagtgtttgacatctttgatttataaaaaacaaaatctataaaatcagctacctgtgagaaataaatcagtgctacataggtagtacatataacttcttgtagattacacattacccagcactacatccaagaaaaatttcaagtgacaatttctttcttttcttttcttttttcttttctttctttctttttttttttttttgagatggagtcttgctctgttgcccaggctggagtgcagtggcaccatctcagctcactgcaaccctcgcctcctgggttcaagcgatttttctgcctcagcctcccaagtagctgggattacaggcatgcactgccatgcccagctaatttttatattttttagtagagacggggtttcaccatgttggccgggctggtctcgaactcctgacctcaagtgatctgcccacctaggcatcccaaagtgcaagtggcaatttctgagtcaaattcaaagtactatcattttgctagttttggaaattcttccaatgtaggcgaaaagagccaattggcaatttatgaataagaatatacacactaaaaattgtaaaattatattttgctaaattttgcttaactgatcattaacacttagatgctgctataaagcatcgacagcatagattaatatgggctgctttagccaagccatacccatagacagtaccaaaataagatactgattttagattccccaagcaatccttataaactggagtgtaatttacaagtgttttccttgtatttgctatgtgagtgttaaagtaactttgtgtttccagaaaaaaattagcataggtcattaggagaaggctatgtcagagaggaaactaaaaagtaactcacaaatacacaaagacttcaagtgtattctgcatactacaaaataagttcctactatatttcatggagtgagggcatctgaacctctttccatgtctggcttccttctgcttgactccttcttatattcccttctccttcctccgttgggaggaggtgtttttctgatggttagagcagaggctttatgggaccacattttataatgcacggagtctaccctaaaagcaggattctgttccctccttttctatcatattttcctgtttaagacattagcaaggcccagtaaacagggcaggcaagttcttctgcttctctaaatctacttggctaggtggatacctccagaatagcggtttgtcagcctggacatcttttctctgaatgcattctgaattgcctactaaataggtctattccaaaatgtacaggaagtacaggagaccagattacctagcaagcctaaattgaatgatgcatttcagacttttttcaataccttattgttattgtaatagtgcagtaactgattaaaatgtaagtgattttaaataatatctatagtgtataccatgttctcaggaaacttgtaagcaaaagggacaaatgacagggcagaatttggtgatttctatgtacatgcctacaatactatgataataccacaacttcacctgcacctcttaaatatattttttctgatcacaatattaatgtcagaatttttatcaatcaaacacaccctcgttattttagtatcttccatatatatttttgtttttgaaccaatatctgagataattagagctatcatatcagttagtttttctggcagaaaatttctgtgattggactctttacagagtttaacagactcattcagtagctgtccaccattaagacattttatctaacctttcgtggaatctgggcaagagctgatgcaatcacgttggccctttcttctgtgatgttactgaccatagacttaagcaagactgccacgacaccattttctccagagctctgcacaaactcttccattttctgtgaagaatttgttctatcacaaaagagtgtcagcatagcaaacactatagaaaagattagtacatacatctaagaagagaaaatcaagcattatcagaaatttttggagtaatggctattttttaactgacctaatctctttctttggaagaagttatggaatatgatatacatggcatctgttatggctatttgtgtaaatatgtgtgtctgtaaaaggaaaagatgaaaaacaactatgacactatagaagaaggagacaatgctagaaaatattatacccagactcttcatttacaatactgtaattactaatatgggttcttggaaggtggcatttgttgtgtttaattccatatgttgtagttctactaaattccttgtgtctattaaggcagggttttttgtttgtttgtttgtttgttctttctgtagagtatttttagttgggagtcattggaaccattacctggctatgagcagtgaggaaaagttactattgaaataattttatatgtctatttctttagctctgtaattctttatacctcatttaaaacttgtcagattatgtctttttccctaaaaaaaaatctttaaaagctgaagtttaataatgatggagattcaagagtctgatactgtggtgtgaaatttctgtgaactagtcctgagaatcccatttataatacagaattatgcagtatatagttacataactgagtgattgtatttctcaggtcattgtttaaatattactaagacactttttttcctgaaatcacactgcataaaatgatatgctactggccaggcatggtggctcacacctgtaatcctagcactttgggaggtcgagatgggcagatcaccaggtcaagagattgggaccatcctggccaacatggtgaaactctgtctctactaaaaatacaaaaattagctgggcgtggtggcacacacctgtaatcccagatactcgggaggctgcggcaggagaattgcttgaacccgggaggtggaggttgcagtgagccgagattgtgccgctgcactccagcctgggcgacccagcgagactccatctcaaaacaaaacaaaacaaaacaaacaaaccaaacaaacaactgatgtgctacctataactgcctgtgagggaccctcatcatcacttttctgtgtctcacaggggcacttaatcctcagtggaagaatctaccagtcatttttccagtggagatctcttcactatcttgagtagctcattcacacaatataaagcccttgttgaatatgtgtttgcttgaaatttattgagaattactctgaattgtggtttcccttatgttctcatttgtaaatgtaaatgcatagtgtaattccacattgctcagtgcatacgcctatcaagacaaaataaagagaaagagaaatgtagcgccaaaagttttcagtatataatgtcaaaattgaatacccatctttttgttgttgttgtttcttttgttttccatttattatttatttattttctctgtaaaataatgatgaacccattctgacataaccggtatactttcagatcctaaacatgggaggtaaactttcttttaaaaacttgtttaaaaaaagaaatcctaaagtttgtgtatgcacaacatattttgccaagtatttttcaaaaatataatttgagccttatgacattagttttaattggagagtcactgtactactattccaggtagttcttggggctcccaggtattctgtgtgactcgttacctgtgtgaacacaaagtatctgaaacagttctcaatttagaaagtttattttgccaaggataaggacatgctcatgacactgcctcagaaagtctcaatgacacgtgctcaaggtggttggggcacagcttggttttacacattttagcagacatgagacatcaatcaatatgcgtatgacgtacattggtttggtcaggaaaggtggggcaattcaaagtgatgccttcatgtcatagataagagttaaaaggttgcattcttttttgggtcttagatgagccttttgctgaatacacagtatacatatgagagaagggttgagaaatagtcacttatgccttagtctgactcagtaaatctgcattttttccataaacaatggtgaagggatggctttgagttctgtcctcttttgtccctcacctgtgaagataagctatcaatttacatttccagggtgaaattcaacagaaatgtttcaggttaaagattttgaggcccacaaggaatttcctcttgggaagattgtaagggaggtatgtaacttaaaaacaacaacaacaacaacaacaacaaaaacccaactttgtagctattttatttaggaataaaatgggaggcaggtttggctgatacagtttccagcttgacttccctttgacttagtgactttgggttttcaagattatttttctttcagacctgtagccacatttaatggaacttgtgtttgatgttttttctcaatgcctcgctgcccagagtcttcttcatccacccaatattgaggtagcatattgtctgtttatacactcatcagtgatctcattctgggatatcttcatgaaaataatatatcagtgtacaaaatattagagtatgaaaagcttaaaaaaattaaatttccctcatactctctgtctagagctattcctgatttaaatttgtatgcttttattatggtttttattctatttatataattcactgtgatgtttatttagataattttaatcttattgtatattccttttcatcctgcataaaaattgtgatctagttctattcatcattttgtttctcagtttccgacaattcttgtattatagctgacactgtaattatacatattttgataaaatgattgtaatggcatagaatgcatattgtatacatttttacatagtacccaatagtttttcaggccttctgcccttctcttccctctgtagtagtccccactgtctattgttcccatttttgtctatgtgtgccccaagcttagctcccacttttaagtgagaacacatagtatttagttttctgtttctgggttaattattctggttcatgtgtgtgtgtgtgtgcacaaatctccatgtatttgtttgtttatcttggctttaatctgtcattttattttcttttttcaaatgttgtctgcctatctatctatatatttatctatctaatctatctatctatctatctattatctatttatcatctatctatatatttaagaatgaggacatagaatgattcactgggatatctttgtatctgtgaaggacttagtatctggttggctttgatttttatgctgaacgcgtacaactactagaccttacctaaagggaaccaaaaatttcataaaaaagattatactttgatgtgttacatcaattctagttttctcattttaccctggtgaatttatttcaatttctttaaggaaaaactctctagtttttgtgtggaaagtgcaaagaggaacgtattatgtaatacagtaagggttagtgcatttcattttcatgtctttagtttcctttagtctgtaattatcccttcattttttgtctctgttaatttttgacttctagatgaattattgaccagttgttttgtagaatgattcttattttacatttgtttaatgttccttcatgattaagttgctatcacacattttttgaaagaatactgcagacatgttgttgtagtcttcacattacatcatttttgggcagcagatagtgttgatttgtcatgctggtgatactaactttgatttcttggttaagatgctgtctacaggtttattccctgtaaaattataatttctcattttggaattagaagtatcttgataggagactttgagactgtaaatatcctgtttccattacatcctttccctctaattttagcatccattcaaagataatttttgcctgaattaaattactgtggagtttgtctaatgattatttctatgtctataatttctttaacaattagtaagagaaattctactctaagaaagaacattttttcccttttatttccttatactggtttctgtcaatatgatttcatgagtatttggtttattccaaaggttacaatccacagctatcattattccattgctcaaattggtccagattcgattcattgggacttccttcagtttccttctatatttttctgatatgttgtcatcatgttgtatacttatttactttctggcacccctagatatttcaggcacatcctgtacttttgttgcctcaggggtaatgtcatttatatcttgaggaaggcatggttcgttttattggagtatagtgtctagaagcaaaatttcaagtacttagcatgttcattgcatctgggatattattacttctaggccatttacgcatagacattttggaaatgtatctatgcataacttttcattaacagcttaagagaataaataaattatcatttccataaaatacagaaaaaggagagtgtagtaagctaaaacatggtaaatctaaatagtaaatatttacagataagctcaaactaataatttaatgtaaaaagttattttcatttaatgtcatgtaatagttatatatcaatttaaaaaagaattaaataaactcacccattatggtagagattctcagatatttcaatctagcttttatttttgtttaaaagagaaacacctaataaaaattacccatattactataaaatatatacagattttacaagaggcatatacccaatagcaaataaatgaaaattgatgcaatgctacaaaaatcaaacaaagcagaattaagatgcgaagtatcaaatgtgataagtgaatcatttcatgtggatagaaataattcacttaaaattaacaataataagtatttggagattgaaatatatctcagaaactgatagattgaacagagaaaataaattctatgaaagttgattgtattagcaacaaaagtaacaaaaataacgtactgaatcctgcatcttcaaatagagtataaatattcttttgaagtgcacatgaaaacttttataaaattaaactaaggcaatgtcacagatgaaatctccacaaattctgaagtatatatatcatatgtatctatataatgtgatacaattaaaataattataaacttaaagagaatgtattacctttcaaatatacacatttaagaatttcattcagtggagtggactgtgcttaccattcatgacccaagtctttactaccttttctgctccaaacacatataccatgaagagaagacggcatagaatatactcaggtaagtatacaactgagaaaacttacacaccagttgttagcattagagaaaattatatgaatagattcttataggagctataacaagatggttttggcaggataaaaaatgtggcaaaagccttaaaagtggaaaacaaaatttacctacggagttcagggaatttctgttctgaaaaaatgtaagttgtaataactaaaaaattaaaacaaattataatgaaactgatctctctagatgacagcagacacatgcaggaaatgaaagtttgcagaaattaacagctgttgaagattaactcatgaaaaccacatgaggaaataaccaattctacacaatagtaagattttcacccaaagtttataaatataggaaaaaatcaaaataattttttttctcagagatgagaaaatacttaacataaaaatggaattgggtgagaagcatgaatagaaagaggaacatttagaaattgtggaaattagaaatacagtcactgattgtataaaatgtaatagagttcacaaaataaaatggaaccgaatgaacgaataaaagaatgaacaaaacctgcaataaggtgaattagtaaactttctctttttctgactgaaccttgactgatagagcttccaacagaaatcacctaatactgtaggaattgccattaagctgattaaaatatgaaagtgttatttgctattaccacatgttagagccctcctgattgcctgctttacttctgaagctctgtcattatggtttcctggttttaatcactcattctatgcttcactgaaatattttgaactgattcaatgtgtttctctcaaatttaattttattctatcctgtctcttgcctcctgcaggttctcactgtgagcaatccagctccagagcttaccttctctgacctagggttcctcatttttttttttttaccagtttatctgaacttcattgatcttgttcctttgccaatcactctgagccactgtcatcatgactcaggattctagaatttgaacaaattataaatttgccctttgtatcttctgtatcccaaagaagaaccagtagacggtaccacaagagaaaaatgagtgcagtacatgaacaaaacacctgaatgaatcacaaacaaaaagagatggttgattagatttataattaagcatttgccaatcaaatcagtgattcatttttatattatttggattggtaaaatttaacatccaccatagatgaagcacgaaataactgtccactccagtgctgcataggtgggtgtacatagagggaggtagtgtttgaaggatacccctgggctcaactgactcaagctagctcagtcttggtaagagggagactggacacttctggtacagttgggctgcagacacactgtaccaactgtaagttcactttggtgagaatcttcatatgccctcacttgaaagaattttcttttccagataagtttatgccttttattcatccgaattttaccatgatgctgtgctcaaagatacaacaacatttgaggcactaaaaaatgaaaaattttaaatattgttgtctgctctaacagttttcaatttactgaaggtggaaattttacagttattaagaaataaagtaaactgaaaaaacataggtggagtgagactgagagaaaaagaaatggagagagtcatggaactcttcccagcagggtgaaaattattggatatttattaagaaaagggatgaatgaaatgaaaattaacatggctaaaaaaaggtctcaacacaacattatgagaggtaaggtggtcaaatgagactttttgaaattaatccaacctaaaagggccccaaactaatcagtttcatttatcgcagtgtggagtagtttaaaaagcaggaatgcagagatcacagttagaaagctgcttaataatttcttcagataatgctgaggcagattaatcaagataaaaattaacacacaaaaaaagggtttattggtttaaggccctgctgttgacccaaagccttgtgtaagactgtcaggggatagggaacagaaattccagagactccttaatacaagaccccatgtgatatgctaccaagatgcattggggaagccttgaccgaggttatagttaggttgagaaaccataaaaatataaagattaatagaattatgaaatttgtgatatttaaacaggcttaatttaaagaaagtgtgtctttttaacttaaatgtcttatgaaatggactttatgtctggctggaaacacttgttctgcctattgataatattgtaacacaaaacctgctgataaagtcctaaaggagcttaagtaaaggttaatgaaatgaaaaggaaaatgtataggaaagttggtatttttgaacatactttatgtgaagtagtatctattttatctgaatgtgtcaaggttgaaggacactgtatctaactaggaaatgtttcttgaatctaatattgtataacagaaggtatgcaaatttgcccttcagccaacattaattggacatgctaaatgaaaaccactatggtagggtggagtcaagatggccgaataggaatagctccagtctacagctcccagcatgagcgacacagaagacgaatgatttctgcatttccaactgaggtaccaggtgtatctcgctgaggattgttggacagtgggtgcaggacagtgggtgcagtgcactgagcatgagccaaagcagggcgaggcatctcctcatctgggaagtgcaaggggtcagggaattccttttactaaccaaggaaagggtgacagatggcacctggaaaatctggtcacttccaccctaatactgtgcttttccgatggtcttagcaaatggcacaccaggaggttatatcccacacctggctcagaaggtcctacacccacggagtctcgctcattgctagcaaagcagtctgagatcaaactgcaaggtggcagcgaggctgggggaggggctcccacaattgccttttgtttggctatgccctgaccccagaggtggactctacagaggcaggcaggcctccttgagctgtggtgggctccacccagttcgaacttcccagccactttgtttactcaaaaccgctcaactatatggaaactgaacaacctgctcctgaatgactactgggtacataacaaagtgaaggcagaaataaagatgttctttgaaaccaatgagaacaaagacacaacataccagaatctctgggacacattcaaagcagtgtgtagagggaaatttgtagcactatataccctcaaaagaaagcaggaaagatctaaaactgacaacctaacatcataattaaaagaactagagaagcaagagcaaacacattcaaaagctagcagaaggcaaaaataactaagatcagaatggagctgaaggagatagagacacaaaaaacccttcaaaaaatcaatgaatccaggaactggttttatgaaagaatcaacaaaattaggagactgctagcaagactaataaagaagaaaagggagaagaatcaaatagatacaataaaaaatgataaaggggatatcaccaccgatcccacagaaatacaaactgccatcagagaatactataaacacctctatgcaaataaactagaaaatctggaagaaatagataaattcctcgacacaaacactctcccaagactaaaccaggaagaagttgaatgtcttaataggccaataagaggctctgaaattgaggcaataattaatagcttaccaaccaaaaaaagtccaggatcagacggattcacagcaaggacttcatgtctaaaacaccaaaagcaatggcaacaaaagccaaaattgacaaatgggatcttattaaactaaagagcttctgcacagcaaaagaaactaccgtcggagtgaacaggcaacctacagaatgggagaaaatttttgcattctacttatctgacaaagggctaatatccagaatctacaatgaactcaaacaaatttacaagaaaaaaacaaccccatcaaaaagtgggcgaaggatatgaacagacacttctcaaaagaagacatttatgcagccaacagacacatgaaaaaatgctcatcatcactggccatcagagaaatgcaaatcaaaaccacaatgagataccatctcacaccagttagaatggcaatcattaaaaattcaggaaacaacaggtgctgaagagggtgtggagaaataggaacacttttacactgttggtgggactgtaaactagttcaaccattgtggaagtcagtgtggtgattcctcagggttctagaactaggaataccatttgacccagccatcccattactgggtatatacccaaagaactttgaaacatgctgctataaagacacatgcacatgtctgtttatagtggcactattcacaatagcaaagacttggaaccaacccaaatgtccaataatgatagattggattaagaaaatgtgtcacatatacaccatggaatactatgcagccataaaaaatgatgagttcctgtcctttgtagggacatggatgaagctggaaaccatcattctcagcaagctatcacaaggaaaaaaaaccaaacaccgcatgttctcactcataggtgggaatagaacaatgagaacacatggacacaggaaggggaacatcacacactggggcctgttgtggggtgggggcagtggggagggatagcattaggagatatacctaatgttaaatgatgagttaatgggtgcagcacactaacatgacacatgtatacatatgtaacaaacctgcacattgtgtacatgtaccctaaaacttcaagaataaaaaaaaaagagtttttcaggatgatggtccatcctgaagtacataggaaaaaaaaaaaaaaggaaaccactatggtattccaagttcatacaatgtagaatagaagctggagtgttagtacagaaagcattatctgttcgatagcccggataaacaacttcaggaaagtttcaggatgcaaaatcaatgtgcaagaatcactagcagtcctatataccaacaaaatccaagtcaagagccaaatcaggaacacaatcccattcacaactgccacaaaaaataaaataaaatgtctagaaatacagtttaccagggatgtaaaatatctttacaaggatcactacaaaccactgctcaagaaatcagagatgatacaaacaaatggaaaaaaaatccatgctcatgggtaggaagaatcagtatcattaaaatggttatactgcccaaagcaatttgtagatttcatgctattcttatcaaactgtcaatgacatttttcaaagaattagaaaaatgtattttaaaattcatatggaaccaaaaataaaaagcccaaatagccaaggcaattgtaagcaaaaagaatgaagctggaggtatcatattacctgatttcaaactatgctacagggccacagtaaccaaaacagcatgatactagtataaaaacagatacgtggatcaatgggacagaatagagaactcagaaataaggtcgcatacctacaactgtctgatctttaacaaagctgacaaaaaaaatggggaaaggacaccctatttaataaatggtgttgggataactggctagccctacgcagaagattgaaactggaccccttccttacacaatatacaaaaattaactcaagatggactaaagacttaaatgtaaaactcaacactataaaaaccgtggaagacaacctaggcaataccattttgtgcataggaacttgtaaagatttcatgataaaaacaccaaaagcaactgcaacaaaagaaaataaaaatgacaaacagtatctaagtaaacttaagagtttctgcatagcaaaataaaatattaacagagtaaacaaacatactaaagaatgggagaaaatttttgcaaactatgcatctgacaaaggtctaatatctagcatctacaaggaactaaaacacattttcaagaaaaaaaacattaaaaagtgagcaaaggtcatgaacagacacttttcaaaggaagtcatacatgcaaccaacaatcacatgaaaaaaagctcaacataactgatcattagatgtagatgatgggttgatgggtgcagcaaaccatcacagcacgtatatacctacgtaacaaaccggcatgttcttcacatgtgtcccagaacttgaagtataataaaaaagttaattaattaaaaaaagaaaaatgtaaatcaaaaccacaatgagataccatctcacaccagagtggctgttcttaaaaagtcaaaaaattaccgatgttgatgaagtcgtggaggaaaggaaacacttgtacactctaagagtgtaaattagttcaatcaagaccagactaaatatagatatgcatccagaaatgcttttagaaaatatatcatatgtttataatacataagctaataaaatgggagagttctctgattcccctggcaggatgtgtgacaggggtgtggctcacctgtttggtcacccggcagctcaaacccctaaggcagatgggcaggtgcagaggccaggcaggtgcagaggccagggcagagcgttttggactctcagccccatggcagcgtctagggctgggtgcctacaaccacagtgttactaagctctgtcagctttgccatctgcaggcggcttgtgtgttagttagcccaataaaccctctgccttatctcaagggcagaaggccagtgtgacagtcttatgtatcctgagttcttgcccagtgtcccaaaagaatcggatcacacgtgagcgtgaaggattgaatgcaaggttttgttgttgttgttgttgttgttgttttctttcgttttgtttttgttttttagagacggagcctcactctgtagcccaagctggagtgcagtggcgccgtcttggctcactgcaaccttcacctctggggctcaagagtgaatgcaaggttttattgagtggtgcaggtggctctcagcgagatggataggtagcagaaggagggatagactgggaaggtggtcttcccctgcagtcgggctgcccagaggcaggactctgctctgaccgccgccagctccccaccaccccacctctccgctgaactatcctaagcatctagagaggtccctcctcttctctatttctctgccacatcgttctgccgttgctagtctgcttgtcggctggtcgtctggccttgatgttcagctgcttgtgtgtgtgcctgctaaggtctcaggtttatgtgggcacagaatggggggcgtggtaagccagagaggtcttggaaaatgcaacattcaggctcaaaaacaggagtgcctgttctcaattaggtctgtgggcacatgcccgagggtgaatccctcaccagtgaccttgctcttctctaccccacacttcgctgcccaatctccagttccactaatatatctaaaagtcacatgggatccctccagtctagattattggtgagactactgaaagcttcaggtacaactttaacatctgcttaccttgtttttttttctcttaaacagctttagtaatgtataattgatgtactataaattctacctatttaaagtgtacagttgataagttttgacatgtaaacattcatgaaaccattactacaatcaagataataatagatcaattgccgcaacagttttatcatgttcctttgtaattgtcttatacttctccccagtctcctatagccaggtaaccattcatctgttttctgttaatagagctttgcttgcatgttatagagtttcatataaatggaaccacagtctgtatacttgtttcactagcatctttcactcagcatcattatttttattttgagatttatttactcttcatgtaccaatggttcattccttcatagtgcggagaaatacctcattgtatagatatgctacaatttttttattcattctctgttgatggacatttaaattgtttccaatttgaggtcattgcaaataaaattacgatgaacatttgtgtaaaatctttaaatggatatgtgttttcatttctcttggctaaatacctagaagtaaattggctagatcacagggtaagtggatgtttaactttttaggaaactatcaaactgttttccaaactgattttaccattttatttccaccagcagcgatggagagttctggttgctttatattcttgccaacatttgatatgacctgtctctttaatttcagcctttctaatatgtgcatagtacttcattctggttttagattgcctttccctaataactaataataataagcatcttttcatgtatttactgaccatctgtatcttctttggtgacatgtcttatccaacattttaattactttgttttattatttatcgagttttaagagttatttatatgtgttctatgtatcttttagcagatatatgttttgtaaaatattttttatttcaatagctttcggggtacaagtggtttttggttatatgtattaattgtatattagttaattctgagattttattgcaaccatcacccaagtagtgcatgttgaacccaataggtagtatttatcccacaccccattcctaccctctcctttctgagtctctaaagcccattatattactttatatacctttccgtactcacagcttagctctcacttacaagcgagaacatacgttgtttggctttccattcctgagtgatttcacttggaataatggcctccagctccatttaagttgccgcaaaagacattattttgttccttctcatggctgagtagtatttaatgatttatatatacacctcattttatttatctactctttggtcagtgtagacttaggttagttccatatctttacaattgttaattggattgcaataaacatatgtgtgcatgttttttttttcttcatataatgactctttttttggtggggggatagatacacagtaatggcattgctgtattgaatggtagatctacttttcatttctttttttttgagatggagttttgttcttattgcccaggctgaggtgcagtggcgtgatctcggatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctgaagttgttctgcttacttttgagtaatatcggtagctgacattttctgagtactgactgtgcccaatctgctctgtgtgctgcctatattttacctcacttaattcttatcacagtcttataagggatttttttttttttttttgagacagagtatgccctatgtggcccaggctggagtgcagtggtgcgatcttggctcactgcaacctctgtttcctgggttcaagcaattctccttcctcagcctcccgagtagctaggactataggcaagcaccaccatgcctggctaatttttgtatttttagtaaagatgggtttttgccatgttggccaggctggtctcgaactcctgacctcaagtgatctgcccacctcagcctcccaaagtgctggaattacaggcatgagccacagcgcctgacttgttatctttattaggaacaaagtttcttctgagtaaacatttagtctttttgttgttgttgttgttgttgttgttgagacagggtctcgctctgttgtctaggctggagtgcagtggcatgatatcggctcactacaatctcctcctcctgggttcaagcattcttctgcctcatcctcccaagtagctgagattacaggtgcgcggcaccatgcctggctaattttttgttgttttagtagagatggggtttcactatgttggccaggctggtctcaaactcctggccttaagtgatccgcctacctcggcctcccaaggtggtgggattacagttgtgagccatcacgccggcttcttggtggcatcttgatacagggtgtgctggatatctgtggccaccctgatcaattttccaccttgctctattccttaagaatctcattcatagggactacacaataatcgtttatcttctctcagttttggttgagttcaggcatttgaagataggaagaaagtaagggttttgaactatttattttcatggctccctctatgtagggttaacatagggtagctctgtctctctatctatgacctcaattccttttcaaccctatctatacatctattctatctgggctctagtaactctgccttccacttgcccatccaggcccagggtagtgctatggaatgaactcccatccacccccaaattcatatgttgaagccctattccccaatatgactatattcgaaaataagaccttaaggaggttattaaacttaaatgagttcataagggtgtggtcctgatccagttgggttaatgtacttattaaaagagacaccagagagcttgctttctcttctcattcaggcaccaaggaagggccatgtgaggacaaagcagctgtctgtaagccaggaagggagccctcaccagatattgtaccctgttagaacgaaccttgatcttggactgtccagtctctaaaactgtaagaaaattaacttctgttgtttaagccatccagtctgtggtattttgttatggaagcccaggctgactaattgggatagtaaggcactatcttgtatagtttcttaacactctgcccgcacttttgtaaagagtccctttattaaactccccctaattggcattcatgctgttttctgataggatcctgattcatacaaagcagacaatcagagaacattacccaagctaagaagagtgactgacccaaatgttctccttctctcctggaacttgaaggcataataagagtgcatcttatttctcttggtagttaggcttcagtttctgtttctgttttgaagtgtatgagactgctgtaactcatgctctgttcttttggcccagccaatgtatggcagtttcttataaggatcacaacccaccatctcctcaggctgaccagattcttcacttcagctcttgctggtactgtggatttttcaagactcacttatgtgcatactccatttgaccctagcactggcctttgcagtggtgactccttggagaaaaactcactcagtccatggttaacttgcacacacctccagagttacatgggcatttctagttctcttcacatcttgggaaaccaagagacaatctcctaggctccccctgcttaaacatgctacttaaccattttaactctactgtggccttcacattggctctaggcactctgcttccaaaattccaaacaggaagtggggtgcaaatcctatgtactttcacttaatgtctctgtagacattcagaagcacatttccacccaatttccctctgaccctcttcttggacaaagtttttgtgataccactttgatgataaagaatctagtgaggccttaagatacaacctaagaaagaaggtcaaaaactgcaaagtagaaagaacatttagatttctacaacttttgcaatttcttgtgtatgtgacgtttgtctccttataccacagagattaccaaaacaggcaccagaggaaaaaaaagatgatcaccaccaccaccaccaccatttaataaataatgtgtttagcataacttcaggatgagaaaagaagattagagctggtgggacagtgattctaagacttctcagaggtgatttccaggatgactactccaaagagaagaggcaagtaaactgcagtcctcaggacctgttgctaagaagaaaagaaattctgaagaatcaattcagatctgaaaatattggactgggtcgaaacacacttgaaaatataatctgtcatacattttctcattgcttaggagtatgggcttgggcataaataagattagcattttagcaaacatttactgcttagaagctatgtgaacgtggagaagtgtaacacagaggtgaagagccctggctccagagttagggatgtggcttgaatcctcgctctgctacccagagcaaattatttacttctttgagcaaattatttacttctttgaacctcattttgttttctttaactaggatagctaatccaatagttttttcttcatcaagtcatatgtgaagtacttatcactaacctgttgtgtgtatgcatgttagtgctaagtacttcagcaattgatcatcattattatcaacctgagaaaactcactttattcttgtcaaaggaaaataaatctcaggacccaaaaatcactaagccaaagggaagtcaagctgggaactgcaatgggcacacctgcctcccattctattcctaaataagatagctacaaaaattaaaaagctacatgcttcccttgcagttttcccataaggaaattccttgtgaacaagagacagaactcagagtcatccctgtgctcacgtgagtcagagtccagcctgggcagcatagtgaggccctgtctcgacaaaaatttaaaaacttagctgagtgtgattgtgtggttggctcatgcctgtagttccaattacttgggaggctgaggtgggaggattgcttgagccaggttgctcaatgctgcagtgaggtatgacactgccactgcatgtcagcctggaagacagagtcagatcctatctctggaaaaaaaaaatgcttgtagaatgtaaacatgaggccctgtctctacaaaaagttgcttgggtgtggttgagcccaggagtttgaggttgcagtgagcaatgattgcaccattgcattccagcctggataacagagtaagatactgtttgaaacaggaaaaagaaacaaaaacaacatttgtatgtgggtatgttttatttccggggggctgctataacaaagtattatagattgtgtcttcatattttggaaggggaaaacaagctcattggggccgcttttttaagggcactaatcccatttatgagggctcttctgtcacgatccaatcaccatccaaaggcccaacctcttaataccaacaccttggggcttagaatttcaacaaacggattttggaggcaggggacataaatgttctgatagcagggctttttagaagtgtcatgaataattaaattctaatcatggtagccaagccatgtatcagctttcttataacttaattagaatgccaaatactgtggaagaaacaataacattgcaagcaaatgtgttattgttactttgaaggaagttatcttctagtatagtagaagtagtagatattgtagtggggtaaaacgtgttttctgacaatgactccttttaccagtagtgaactggtaaatgtttaacaaccagctctccagaaaaacaaaataaaacaaaacttatttgtaatgtttgtcaatttatgtggtgtaattactcctaccatgaccaatttcaaactatctatgtgacatctcatcactgaacacaggaagaaatgagaagtaacaaaattttatagtattttcaccatacaggtgcaataattgtaaatataaataacctcaagaacaaataatattaagttataattgaaagaatcaggaagtggtgaattttgaatatttattacttttgtatttaatatagtttacttaactatacttaatattattaactttgtataatttattttttaataatccctatgtttaacaaccagtctacaaaaattttaaaaatttaacaactggctcttataagtcattacaggcaagcttcagcacaccattatgcttaactgcccctcagatacacagcactcatagctatatatgtatgattttataggatatcctggccacagctgatgagagtaaatagggatgggaataggttcaatgtcacttctcccagaatttggaaagggaatcagactggaaatcatcctgtttgtgtggctgaaactataactcatgaaaatttgaagttacaggcagtcactttttgaccattatgtggacttagtagtaaataagatttatcttccagtatagaagcataaaaatatgcaaagggaaaccagaaatggggaaacacatctcatttgtcttaaagcattctagatttcagcggcagttcttgagacctggttgcattctacccttcgatttggacagatacatttaccctcacagtagttttccttttcctctaatataactcgaattgctttttgttatttgcaaacaaaaagatggacatgaaggaaaaaggaaatagcaaaatacgcaaaataataagcgtagtataatactgggtgaaaaatgttcaattgctctatagctcatagatcaaaatagagaactttgccctaactctattcgtagataatgaacattaggataaatatttcaactctcctttttgagaaaaccacaatctaaatacagctacctttctctgtagattctactgtaatgtgtgcttggatttaactgcctctcattgtaaacaagattgttttgaggcagctgaaaggtaaagagctttcctttggcaagctcaacaactcttgtgacttaatcatcatctatacaagaatgattacttcagtcagacttctcacctgatgtcagttgtttccttgacatcttttcttagatgtctcatgattagctcaattttaaaaagctcaacagtacccccttgatccaccactacccacactgtccactaacctactcatgctagggatctgggaattagccttctcctcacctcacatctccagcacttgcagtacagtgaggaagtgagggtgaaggggaaagggagctaaggtacagacaatggctaatttacatctcttggtggcaagtgttacaacaggaatagtatacaacactatagagacatacaatgggaataaatccatgagttagtcatatgctcctttctagaccgttctctgggtactcactgcctgaaaaacatgattttttcttacaggtttcagctaattctgcatctcaccaagaaatttttccttgacaacctctccctaacagaattagttgtctctgttgtgttcctgtaaccgagtatccccatttttcttaagaaaaagggaatgaataactattattattttctcttctctttttccttttccccttgatatggtttggctctgtgtccccacccaaatctcatctgaaattgtaatccttccccatgtgtcaaggaagggacctggccatggggcgataggatcatgggggcagtttccctcatggtgttctcaaaagatctgagttctcaaaagtgagaagtgagttctcaaaagatctgacagtttaaaggtgtgtggcagttcccccttcattctctcctgtcaccttgtgagaaggtgcttgcctctccttcaccctttaccatgattataagtttcctgaggcctcctcagccatgtggaactgtgaagcaattaaaccttttttaaataaatgagccagtctcgagtagttcttcatagcagtttaacaatggactaatacagagaattggtactggagtttgaggcactgctataaagatacttgaaaatgcagaagtgactttggaactggataatgggcagaggttggaacagtctggcgtgctcagaagaagacagaaagacatgggaacaagtttggaacttcttagagtctagttgagtgattttgaccaaaatgctgatattgatatggacaatgaagttcaggctgagatggtctcagatggagataaggaacttattgggaactggagtaaaggtcactcttgatatgctttactccagagactggcagcattttgcccctgccctggagatctgtggaactttgaacttgagagagatgatttaggttatctggaagaataaatttcctttttttttgagacagagtctcgctctgtcacccaggctggagtgcagtggcatgatctcggctcactgcaagctccgcctcccaggttcacaccattctcctgcctcagcctcccaagtagctgagactacaggcacccaccaccacacccagctacttttctgtatttgtttagtagagacggggtttcaccatgttggccaggatggtctcaatctcctgacctcgtgatctgcctgcctcagcctctgaaagtgctgggattactggcatgagccaccatgctcagcctataaatttctaagaagcaaagcattcaaagtgggatctggctttttctaaaagcctgcagtcatatgcattcacaaagagatgatctgaaattggaacttaggtttaaaagagaagtagagtgtaaaggtttggaaaagttgcagcctgaccatgtggtggaaaaggaaaacctgtttttgggggagaaattcaagtcagctgcagaaatctgcaaaagtaaagagaagccaaatgttaatagccaagacaatggggaaaacctctccagggtgtttcaaagttcttcacagcagtccctcccatcacagactcagaggccaaggaggaaaaaatggtttcgtgggccaggcccagggcccccctgctttgtacagctttgggacacggttccctgtgtcccagctgctccagtgccagccatggccaatggaggacaaggtacagcttagttcattgcttcagagggtgcaatccccaagccttgatggcttccacatggtgttaagcctgcaggtgtgcagaagacaagagttgagctttgggaacctccaactagatttcagaggatgtatggaaacgcctggatgtccagggagaagtcagctgcaggggcagagccctcatgcagagctcatactagggcaatgcagaggagaactgtggggtggagcccccacacagaacctccactggggcaccacctcatgcagctgtgagaagaggactactgtcctccagattcccaaatggaagattcactgacagcttgcactgtgtgcctagaaaaactgcaggcactcaatgtcaggacttaatgccacccaatgaaagcagctgcagtggctgtaccctgcccagagccacaagggcagagctgcctaaggtcttgggagcccaccccttgcatcagcatgacctggacgtgaggcatggagtcaaaagagattattttggagctctaacacttaatgactgccctattgagtttctgatttgcacgggggcctgtagcccctttgttttggccaatttttcccgtttgaaatgggaccatttacccaatacctgtaaccccatcatacactggaagttattaacttgcttttgattttacaggctcataagcagaacggacttgccttgtctcagttgagattttggacctggacttttgggttaatgctagaatgagttaagactttggggtactgttggaaaggcatgattgtgttttgaaatgtgagaaggatatgagctttgggcggggctgggatggaatgatgtgatttggctttgcatcccaacccaactctcatcttgaattgtaatccctgcatgtcaagggagggacctggtgggaggtgattggatcataggggcagtttcccccattctgttctcatgatagtgactgagttctcaccagatctgatggtttaaaagtgtgtggcagttcccccttcatgctctctctcccgctaccttgtgaagaaggtgcttgcttctctttcaccttccaccatgattgtaagtttcctcagtcttccccagccatgcagaactgtgaatcagttaaacctttttttttaaaataagttacccagtctcaggtagttctttatagcagtgtgaaaatggactgatacacccctgttctccactttctacttagtcttttagtaatgacaatatagccttttaccatccccttcaccagacgctccctacagggtaagttcatctatgcactctaagacggaactctctttgagagttaacagtcgatttatagaccaaagcatgcctgctatggaactctcacccaccagagggttacctcaagagataacaattgaaaaacatgtccgctactgtctcccagctagggagtttttatcatagtcctgcccacaaaaatgccagaagtcaccagcttgacctcctggtatgtaagggaccaagctaacatgcagacccctcaccttgctcacttcctctcctgccttttaaaagtgcctgctttaggttctcactcataagtaggagttgaagaatgaaaacacatggacacagggaggggaacaacacacaccatggcctgttgggaagttggggatgaggggaaggaacttagaggatgggtccgtaggtgcagcaaaccaccatggcacacatatacctatgtagcaaacctgcacgttctgtacatgtatcccagaacttaaagtaaaataaaaaaataaaaaaataaaaagaaaaaagaaaatgaaaaaacaaaaaaaggaaaaagaaagtaagtgcctgcttttgctccagaaacaaagtagtacatttaaagtcaagactcctgtgcttcttcccctaagctagcttgggaaataaatcactttgtttataccagacctcgcttttgttaattgggctctgcaagcattgagtgactaacctgcatttattagttacattctcactgcatttgtacttgtctccattacaacaattataattatagatacattttaagttactatggagccccagcagaatgcctgtcacatcaaaattatcaaagaagtatttagtaaagagaagaaaaaaaagaataaacagaagatatcaacagctctggattctaccagtgaccagcattcaatcaactctatataaattattctctctgttcctatattttctcctttgtccagtaagaaattggactcatggccagatgcagtggctcatgcctgtaatcccagcactttgggaggctcagtggggtggatcacttgagcccaggtgttctgagaccagcctgggcaaaatggggaaaccccattgtgggggttcagtcaggctggtgggaaaaattttagttatcatagccacaaaccctcttggaaggcctgagagtttgcataacttcagtaatagatctagctgaaggcagcctagtccctttacctttagttaaataggttaaagtagatacaaaggaatgtgggggagtttatctaactagcttgtttactcatgtggtcctaagactaatcttagtgtgcttaattgctttctactcgggaggtccgcaatgtcaattaccctctagtggtgttgactcaagcctttgtcaattaatctttactgaatgaatgtgagtcttgctgtgtctaggctggaggttccaactatttacagcactcttcttggtgtctgtaagtggcctggatgctcagccagactggcaaagcagaatatctgtgtcagtgcacgttattcatctgtcattgggtcagggtctgcaggacagacccctgcaccccatctctacaaaaaacaccccctgcaaaattgtctgggcatggtgccacatgcctgtagtcccagctacttgggagactgaagcgggaggattccctgagtccaggaggtggaggctgatataagccaggatcatatcattgcacttcagcctaggcaatagaatgagaccctgtctaaaaagaattaaaaaaaaaaaaaaaggaaagaaaggaaaaaaagaaaaacgatatggagcttgaactttccttgactttgggcacgtcacatggcttcgatttcttcatctataaaatgtcaaccacagagttattgtgaagatcaaatgagctgtgcatgtgaaatgaaactacctttacaagcattaaatgctataaaaattttaagcatggcttttagtagttttagctctaattttctattattctaaatagtggaatgtggtagaagtatatcactgttttttctttttttctttttaaccagtggtggggataaggggaaggaagtggttgaaaaatcgaaagggaacttcttacttgggtaagtctggacttaattgtgccaaactttctaaagcagcttccaggacaaatttccaggaatatttaaaaaattgtttagactgactggaacacagatatgaagccacattttttgtgcacgtgtgactatgtgtgcctctggaagatttcaacacaaacacgctctcatctaaattaacgctttcctctgaattgactcatttgaccagcataaccagtttgcatgccagtgcaagcagagaaagttgtaataaaaagaagaaaagaatgaaaggcatttagaaattcggtggttaaatgtacacttagttaatcattgtatttgtttttcaagggcttcctaaccttttggagaaagaaaaatatggcagaaagctgactgaagtttgaaattaatatgtgcaaaatgtctgtagaggatctagtctatcctcctttccttcatcttaagacttaattttatccaaaaattaagtagcctgattagtcatccttgctttcttctcttcctggctccttgggttttttcccatatgtatttgttcagcatctattacaaagcaggcactgcccaaggcattgtttttaatgtacaagtagggagtttgaaattcatcctttcgatcagaagttctcaaactatacggtgtatatgattcacaaggaaaatttgtccaaaatgcagatttctagtcttaatcccagatatcagatttgaggctcttcgtggggcctggcaatctgccattttaacaagtgtctgggagagctgtggctcatgcctattatgccagcactttggaaggacgatgcaagaggattgattggaatttgtgaccagcctaggcaacactgcatgactctgtctccacaaaaatttaaaaaattagccaggtgtggtgttgcatgactgtagtcccagctatttgggaggctgaggtgggaggatggagtgagctgtgatcgtgccactgcactccagcctgcgagacagaggtgagaccttgcctcaagagacaacaacagggccaaacgcggtggctcacgcctgcaatcccagcactttgggaggctgaggcaggcggatcacctgaagttgggagtttgagaccagcctgaccaacatggagaaaccccatctttactaaaaaatacaaaattagccaggcatggtggtgcgtgcctgtagtcccaggtgagacaggagaatcgcttgaacccgggaggtggaggttgcagtgagcgaagatggcaccactgcactccagcctgggcaacaagagagaaactctgtctcaaaaaaaaaaaaaaaagacaacaacaatggccgggttcagtggctcacgcgtgtaatcccagcactttgggaagccaaggagaatggattatctgaggtcaggagttcgagaccagactggccaacatggtgaaaccctgtctctactaaaaatacaaaaattagtcaggcatggtggcagacacctataatcccagctattcagtagggtaaggcaggagaatggcctgaacccaggaggcatagtttgcagtgagccgagatcgcaccactgcactccagcctgggtaacagatggagattccatctcaaaaaaaaaaaaaaaaaagacaacaacaaacaagtgataagcaattcaagggactccattcacctgtttgaaattaataaaacacttagtgattagattaggttggtgggcagctgaactcttcaagattttatctatatctctttaagaactccagaatcggggctctctgttcgaatccagactctgccacttaggagctattcagttgattgtattaatcaagttaacctctttgtactctgtgtcctcctctgtgacagtacatgggaatcaaaatatctacctcagagagtcactgggcagatttagcagataaagcatgggtgttatctggcatatagcagtaagtacaaaaaagtagctacaataataataacataacatataaattaatataataacattgttaccattattggcagtagttttactgtggctctattttttagagagaagagagaagacacaaagttttgcccacaataagtggtcaggtcttggaatatgactagatgattgcttcaaaagagagaagtgttctgactgcttgtatatgtcttctgaggcggaaattgctgttagtaacaaccattttagtttacattttctaaatattattaaatccctgagtagtaggtaatattattgctattctgacattttcttctcatggcttaatttaaaagaatcaaaattatacccagctcagagaggtaaataacaaatgttctcaagaagcatctaaggccaggtgcagtggctcacgcctgtaatcccagcactttgggaggccgaggcaggtggatcacgaggtccggagttcaagaccagcctgaacaatacagtgaaaccgcgtctctactaaaaatacaaaaattatctgggcgtggtggtgggagcctataatcccagctactagggaggctgaggcagggaactccttgaaccctggacgtgcaggttgcagtgagctgagatcgtgccactgcactccagcctggacgacagagtgagactccgtctcaaaaaaaaaaaaaaaaagcatctaaaacaggggtccccaacccccatgacacagattctggtccatggtctttaggaactgggttgcatagtaggaggtgaccagcaggcaagcaagtgagcattaccacctgagcaccacctcctgttggattagtggtggcattagattctcataggatcgtgaaccccattgcaaatcgtgcatgtgaaggagctacattgtaagctcctgatgagagtctaactaatgcctgatgatctgaggtggaatagtttcatctggaaaccattcatctctcttgtccatggaaaaattgttttccattaaactggtccctggtgccaaaaaggctggggactgctgatctaaaagatgtcctcatcataatcacagataatgaatacagaatactcagtatcggaggaaagataaaaagttcagtttgggtcaatttcttcactatttacatacacttagggccttagacccttccatgctaaaatttaaatgcatgcattagctcatttaatctataatagccctataagtaaattgctattataatccttatttatttatttatacatttttttgagatggagtctcgctctgttgcccaggctggagtgcagtggcataatcttggctcactgcaaccttcacttcccaggttcaagcgactctcctgcctcagcactccctgggactacaggtgtgcaccaccacaccacactaatttttaaaatattttttagtagagatggggtttcaccatgttggccaggttggccttgaactcctgaactcaggtgatcagcccaccttgacctcccagagtgctgggattacaggcgtgagccactgcgcctggcctataatctcattttaaaagatgccattataaaacatctttaaaaatgaaatttattctctgaagtgtcaacataataagaaagaaaaaaaagacacttaggttaactaaagtaataaaggaactcaaacttgaaccaagagctatgtgatcttacatctcactttagtctgcatatcaaaccgcctcctagacactttgaggctcacgggtctgaagtgggtgtagtggcatcctgggaagatttaataggacaacaaaggtaagtcacacaatgagctctaaattctagtctgtccaaagcatgctcctttctaaaattatattctaaaatgttaagaaaaaatacaaaaaagggcattttcagaaaatgttttatagtccttcctctgaatgactaactttaccttttttctacattgcatattctttatcccaaacatatgcagaacatgttgatgtgttctctgattacaaagtgttttcaaatgataatgtaatgactcagtagacttgtgaaatgcaggcagaaaaaaatcatttaaaaccaaaattgactgtgctgcttctacctgctaagggaagtggtctaattcgcatcagaggggtaagaggcagagttcccttccccttttgtaaaagaaaaatggggacagcaagcaaaaaatcactcaattgttaggaaaaaatatctaagccaccctctcaccttccttctctttcccaagaattggttgcactactgaaaccagaggagtgcaggaattccactattttgtaaaataagtttgagccaaatttgcctgaatttctaagacaggctactttggttgatacacggattaagcctaaaaataaaaccttttgagataaattgggtagtacacccacagaatcgcgcccgagtcaaggagggaaatccttttggtattgtgtttaaaaatcatttttaattttccctacaacgaagcgaaactcctcacatgtgtttaattgttcgctctgaaagactacacaggccgttacgaaaatagtttttggcatgagtagtgatctagttataaatcagtgaaaaataaattgtgtccataaaaaagttacagaatttacccctgtgccattaaatattagttaacaaccttgatttttaaattgatgtgccatattctaccatatcgatactgtatttgatatggttcagttgcagactgctcttccagaataaataggcagaaaggaatttatcactggctgcaaaccattagatggcttacaaactgtttggaattgtaggggcaggcgctgtgtgagcgtttaggaacaacttccattctccagaaatggcatgggtagtcctgcgatccaaaggcagcagtgtcaggtggaagcgctagaagcccgaggctgccattggcagaacaaagcagtctcggcctggcttggcagcatccaaaaggaccgcagccgccctgccgctgcacacggtgcatctgattggcggaacccaaacccttccgcagccctccctgcgaagatatctgggaaacgtagtttttaccttctaacctctaaggcacggaaagcttattcgatgttgattgtaatggaaatagaactatgtattaggatttgtttaaccatcccttgagttttaaattttttggttgttacgtaattttctctgtaataaataaataaaattccctaaacaatatgaatacttttcaaatttttgataatgattgcaaaattgctctcttgaaaagttatgccagtttatactccttccagcaatctttgttccatattgtcagtcatgattaatacatttgtcaatgcttttgaaaaggaaagtgacatattatttaaaaactatgaatttctttggctagtttgaagattttaattctcaccacaagtgaattacgattagatttttttttttttttttttgagatggagtctcactctatcacccaggctggagtgcagtggccaatctctgctcaccagcaacctccgcctcccgggttcaagagattctcgtgcctcagcctccagagtagctgggatttgaggcatacgccaccacactaggctaatttttgtatttttagtagagatggggtttttgtcctattggccaggctggtctcgaactcccgacctcaggtgattctctggcctcggcctcccaaattgctgggattataggggttagccctcgcgcacggccgcaattaagtctttagacgatctgtttccccagtatttcccagcaatgtatttatgaatcatctcgcatctcgcatggtgagaaacttaacatgaacgttcaaccatgtaaaattattaccagtgaaataaataacttaatgtctagtgacctcttactgtagctctgtattggtagatagacacttcttttttgatctttcaagtatatagtaaaaaaaatgttccttttacagttttcaatttttttttttttttttttttttgagatggagtctcgatctgtctcccaggctggagcgcagtggcctgatctcggctcactgcaacatccgcctccccggttgaagcgattctcctgcctcggcttcccaaggagctgggattacaggcatgcatcaccacgcctggctaatttttgtattttctttaaattagagacagggtttcaccatgttggccaggctattctcgaactcctgacctcaagtgatctgcccgcctcagactcccagagtgctgggattacaggtgtgagccaccgcgcctggctaatttttcatgtttttagtagagacggggtttctccatgttggccaagctggtctcaaactactgacctcaagtgatccacccgccttggcctcccaaagtgctgggattacaggcgtaagccatcgcgccctgccttgttttcaaaattaaacttagttgaagcctgtaagacttaaaatgaaagcaagattatgtgacttgattatgatgcagccaaatgaatttagatgcaaatgctagacttgaaatgtaagtgtacgaatatacagcagtataattttatgaggtctgggggttacttgtgcatgagcccaggatttagatatctggctactcacagtaagatccatggaaggaaataaattctataaggaagcactgtataactcaaagaaactagagaggcccaaatgtccaaagctgccatttcgcttgctggaatttgctggtggaataactacccttccccgaattaatgaggctaaatgaattcctggggaaccctcaggctgtcagtgtaacacctcccacatcttttttctccagcaggtggcatgtacagcaccatcctgaaatggtgataactttattattattattgtcactattcatggggctaaccatcttcccttttcttcccaaataagtacatggagttttagcataggtattaaagaaggctcgtcagcatgatggcttaagtctgtaatcccagctactggggaggctgaggtgggaaccgaggagttcaaggctacagtgagctatgatcatgccactgcactatagcctgagtgacagaaggagaccccgtctgtaaaaacaatttaaagagagaaagagaaagatagagagagagaggattcttgtttcaatgacctagaggaaaaaagatgttataagttcgcttttgaaactggaacattaatttttcaccatattaagacaagaccctgtatatacacgttaaacttaaacagctatcttttaggctgttgaatgcaagaaggtaagtttaagtaccatctagtggtaggcatcaccctccacctagtggcatccctctccatctagtggcaagataggcgaattgaaagcaagtgccaaagaagaaatagtctgatactgaaatgttgagcaaaagtttaaaaagacaacagtattgaccacgcctcctccaagtcccagcgagcccgtgtacaacctgtcccgactccagccgcctcttcagctcgccatggatcccaactgctcctgtgccgccagtgactcctgcacctgcgccggctcctgcaagtgcaaagagtgcaaatgcacctcctgcaagaaaagctgctgctcctgctgtcctgtgggctgtgccaagtgtgcccagggctgcatctgcaaaggggcgtcggacaagtgcagctgctgtgcctgatgctgggacagccctgcccccagatgtaaataacgcgacctctacaaacctggattttttatgtacaaccctgaccctgacgtttgctacattcctttttctatgaaataatgtgaatgataataaaacagctttgacttgaaaaaaaaaaaaaaaaagagaatagtattaaagtaccagataaactttaccactgttttattaaattttaatataaataaactatgtaaaataattcatgattgtagcaggttatctaatttggaaataaaaagaatactcttgctggatggtaaacagactattcctagcatgaggtcttttcttggaattattttatcttagtccttacctagaaggacttaggaagtgacaaacagtgctaaaaacctgagagaaaagttaagacatagtgacagaattttgcaggacaaaagagtgatattagtacagtctttcttatgttaaaccttttatgatcttgaaaatcttatctttaaatcttaagaagctgttggattatactttaatcattgcagggaaaagatttagaaattatgttgtcaaccagtttagatcaaattgacatcagaattgggtctttaggaggagatttttggtacaataactttgtaatctgaggatactaatcagggtataatagtacacttaattagtatgattagctgatagtctcaagttaggatgacagtcattgagcccatatcaggtagttaacagtgagcatctatctgttctaatatgttcagcattctgttaggattagttggtgtccatgctgtccttgttattaaatcatctgaatatcatccaagaccataagggactgtatgttcacaggaaaaaaataacaaaatcacaaaatgtgaagaatgtatgtattatgaaaagaaggtaggcaaacagatatctttaaaagaggaagctaaaaaaataaaaataaaagaggaagccaaatgaatggatcagatagaaaaaaatgttcaaaagtgtaataattgttttaaaaggactaaaaatatttttagagacccaaaggaggaaattagaaacatgaatcagaaaaatcagttatgaaggaccaactggagatattcagtatgaaaaacctaataactgaaataactcagtaagtatggtattagataaaccttatagatgttttttagatactgcttttcagagtgaacacacttgaaatacaaattagtgagctgaaagatcaggtcaatcaactcttctagaaggactcaggaaggacaaagcagtgctaaaaaactgagagaaaaggtaagatacagtgacagaattttgcaggacgaaagagtgatattagtacagtctttcttcagtatcttcaaggattggttcaaggacccactgccttcatagtaaaatccaggaatgctcaattcccttatataaaatggcctgtttgctcataatctacatacatcctcctgtatacattcaattatctctatattacatatgatacctaatacaataggaatgctatgtaaatagttgttatgctgctttggtttttatttgtatttttttaattgttaatttggttttttcttgaatattttcggtcccaggttgtttgaatctgtaaatgcagaacctcaagatacatagggctgagtgtatttgatagaaagaggacagagaaattgttgaaataagagaaatttgaagctaggatgctatatccaattaattcaatgtaaggctgaaataagttattgtaaggtacacaaggcctcagaaggctgacaaaaattctgtttgaaaacactttgggaggatgtgctcaagtaagacaaggaatcaatccagaagttaaccaagagatgtgaaaagtgtggaacaagtgaagctttgtaacgtgtttagataaaaaactgccagaggcatctttaatataaacagcttcaggaagagagacacactgtattgctttctttatcccagagattttggagcgtatacataggtgtcatgcatgtcgtatgtatatgtgcgtatttgttggaggaacaaagcccaacccccacccccgacaaaatcccatgagtttatttacacattgtacatgagaatttgcgctatttcctatcttcagacatgatatttaaaatatataacaattagtacaacatagggcactgaccaatcagaatagacaccagccaaactgctagagcagcttcctggatgctgtgcccttcatgtccggattatgagtacacctctggtgggctggggcagaggcatggggcaggggctcaaagtggcttctatttaccatgtatataggattgtttcaatattttaacaacttgtatggtcatgtatactgactgaatagcaactctgctatgagacataagacatgtttgatgacttcatgcaattttctgaaacatgctctttttttttttaaataaaccttgggcagatgttatgttaagacagtctctgtagtaaaataatttgccatattggagaggcttatcatctttacaatgaaagtcagaaaatataagtaaaacatattaagttgtactaaagcagagagaataatcaaatataatcttactcaagatattttcatgacaactcagcttgcaagatgttttcctaggcttactgggtcataaatattcggtatcattttttttcctatattttaaagaaaaggaatttggaacacgtaaactataaatctaagttttaaaaaatctaaacaacagtttcctctcattgcagacctcattcaaattgcaggctggagccatgcccaatatgcctcttcagagccacaactacccacaggtaggtgggcacttggtgagtgaggataaaaagtttgttgttataagtcattgagttgtgcagttgtttgttacacagcaaatgacattccttttttacttattcatcattcattcaacgtattctaaacatataactatgaactataaaaactcaaaactggcttttcttttaaaagactgactagacaaatttatgttaaaactaatcaggaaaggaatggagatgcaaataaacaacagcacctatgaagtttgcattctactattgaaacagaaaatacacaaataaactgggaatcccaaatggttcataagcaaacgaagagtgacttacccttactctgtaatcagagaactgcaaattaaaacaattggaaagtctgacaatatcatgcagtggtgaggatgttgggaaataagaaacctcccattcaacttaagggaaagtaagctgttgcaaccattccagggagcaacatgaaagtacttggtaaattaactatctttatactttctcaatgatgtagcaattacacttctaggtttcttgcacatgtccctaggaatatttttcacagcaatgtttgtggtagtaagaatggagaaagtctagatgtccattgacagaggaatgggaaataaaataagggatagacacataataaagttatattcagcactcagaaataatgttctagattaatatttatctggatggctcttaaaatatcatgacaaattggggaataaacaatatgagatttataaaagaataactttcaaggatattacatgcatatgcccagaaacaccaaattcatctttaaagatacacatatatctaaatgaatatagcaatgatatactggtagggtataaattaaatatgtaagggtggggtgaggtgagaatggtggatgcatgggaaaaaggtagtaaaaagtagaaaggtaaaatttaaaaaggggtattgcacagacgctgaaaatgtgcaatgaaatgaagggtgtgattaattcaattttgtgacttgatagtctaaaaataactatatgtagtagaatctgaaatatgaggaatagggaactttaagggagtatatggaagtcaacgccgtctaagcatgtgcacactgaattctcacactttcgatgatgtcctgctattatatcttttctaagcttagaggaagataaataccacagtagttatattttaattctagttttatttaggtaaatgataataatgagataagccacaaagttcgaattgacatatctattagtattagtatacataaatgtagaaaatatatttcaaaagaaaaaagaacgtactatgatcatcaaaaacctcacctttccacatgatacatattgttgatattttgatatttttccaccatggaatttattttgcaattaccttgttaatcagtataatgtataatgtgaggattaaattgcatctatggatcttgatgtgttatctttagaacttatttagattgaagctttcattttatctttttcaaactactatattaatgatcttgaatgaagattattataggagttcagtgcctcgcaaaattttcttgtacttaccctgtgcttcatactcttattgtcttgcctcctttgaataatcacaaaagaaaaagaaggcaaaggagtatatagcacaacctattagaggaaatggctgaaatagtattctcttaatgtttaatgtgactattaagagggtattatgctggcatgtaaaacagttaattgtattcagtgtgttttaacatcactgattaattgatggcgtagtgaatgttcatcttggagaaaataccacctttgtatctcaggggatctaaagaatgtcttttgctgctgaataaagtgcttcaaaaagttcaaagggagaaatgtgtatttttttttatggtaaggaagaatagattttaccacttgggaaagtaacagcttatgaaatcacgcagtgatgactgtaattcagctgtcgtctgtttctttcaccttctaaccagtgaaaaaagttaggttacttatttctttgactaagtaaattgaaaaggaataaattcagaaagattatctaaggaaactggttattagagcaaaatggtttgtattcactctgtaaatgaatgctcctgctgcttttctcttcattttaatcataatatttcttttttccagttgcttcatgtgaattttattttattgtttgtttttgtttttgagatggagtctcgctctgttgcccaggatggagtgcagtggtgccatgtcggctcactgcaatctcctcctcccgggttcaagcaattctcctgcttcagcctccccagtagctggaactacaggcatgaggcaccacgactggctaatttttttgtatttttagtagagatggggtttcaccatgttggtcaggctggtctcaaactcctgacctcaaatgatctgcccgccctggcctcccaaagtgctgggattacagcttgagccactgtgcctggccgtgaatttttaaatatatcacatttcaaaataattttgcagttccaaaataattattttgtaattcaaagacagttgaataagcaaatcccttgggatttgattgtgtcagaattataaggtcctgcttatttttatttttatttttggaatttgtctgatggttgcagattattgtcaccggttcctcacgtttgttcccaaaagaagtaggatttgtgagacttggttccacctttgattttgatccatccctctgaatcaggctaagtcacagactccctaggtcattgccacaattttataagtaagacaactaaaaataatctatagtactcactttcaaaagatcaatcactcaattcactgagtgttaataactgatttagctcagggagaaggacatttctcttattattctctataagaaggtaaaatatctaggttcttacatttttgaatagcaaagtaatgttgaaattagatggacaccttgacatgaatctgaataaaaataacatatctcaggaatcttttagtattatattattgatataaaaattattaaaataggctgagcgctgtggcttacgcctgtaatcccagcactttgggaggctgaggtgggcggatcacgaggtctggagatcgagaccatcctggctaataaggtgaaaccctgtctctactaaaaatacaaaaaaaaaaaattagccgggcgtgacggcgggcgcctgtagtcccagctactcgggaggctgaggaaggagaatggcgtgaacctggaaggcggagcttgcagtgagccgagatcgcgccactgcactccagcctgggcaacagagcaagactccatccccccaaaaaaaaaaaaattattaaaatagcaatattattaatgtctacacttggtcttagccaaaaggccaagaagatatagtttcttaaatttctgagatctttctaatttataaaatgctttaatatacagctttatttttattaatttaatttaatttaatttatttattttttagatacagagtcttgctatgttgcccagcctagacttgaactcctgggcccaagtgatccttttgcctcagactcctaaatagctggtactaggcgtgcgcatcactgtaccttacctccatacgcagctttttagaggcagaaactatttcactgacttctatcccttaaacccagaaattgccagacataggttaataagtgcctaaagtaaacttcagtcttttgttgctgtttcccacctcctatatttgaggaattctctgcaatatgtatctttaacagaagctccaaaggccatgtgctctatatcccatctttctcttcaactacagcacagtaacgtaacttaggctcacctgatcagctgtacccagttgaactttcactgggagctggtgatgcaaaagagtagcaatggtggagaatctattctgatagtggcagcagtatagatagcaacaacctgttccagggcagtagtggaaatgaaactagtggtggcatacggtggctggtgcctgaggtgatggctgtacatgtggtggcatccagtgttcagccatggtgggagcagtccccttatgaccctggatctatggttttacttgtggatctggctggtgcatagtgctcattgttgatcttccctttttcaaaacttgtttctttattcttcttgacaattctcttagatatataaaatccttttaataaattctgtttaaattagaattggcttctgtcacttgcattaatatacttgacaaataaaatatgaaactgacttgcatagctctataaccctatcaagacaggttttacgaatactgtttatatatcagtaagcaaagactaagagacagtaatttacttggctaagattaacgtttagtaagaacgaagagccaggaatcatacatagtcactccgattctatgcctgggtctctttcttccctatcacagtgtggcagagatgggttaattttctaagtacacagaaagcttacatttcacaacttctcttttaattctcagcatcatcacttggtgtagagtcccccagagagcaacctgatccatatcacaaacctgagacaaattttggttgccttaagcccttacaatttggagtttattcttatagcagctaatgatctttactccaattaatgcagaaattagtaacaaaattgaggtgctgtcataacaaaaacttaaaatacgtgacattgacagctgttagctggatagtgaggagagagataccagagatctatgttatatggtggtaaaatttttggtaaatttattaccttcttacaagacagaaaatgtacctactgggcttgtcgttttagaggaagagtttgcaaaatcaaatgttggcagagtttgttgggaccgttggcttatttggaaaagtgtagtaataaaagagatgttcccagaagaagattgaccaattgatgaacagaaatgaaagtagagagagaacagaaattcagagcttttcaagttgaatagtcctaactttgaaaccctaaatggtaagaaatggacttacaaaaggctttgaatgaaagaagtccagtacaacttgacactaatagttggataaagggactcacagcaaagatcagattagggtatgccttacacattgtttgctccaaatagactcaaaatacctgccattaagtaaaaagaggaaccacagtggcaaagaagcaacacagatcagactagacaatcatttctaggaataaactattggtatagttactggcacgtggatttgattggaaacaaacagatagaagaatataaaattttgaataaatgattttgccaatggagtcatgaaattgcaataaaaaaacacgtaagatatcagaatttaacacaacctgcatgtcctagaccttcaagcaggtggcaggcagtaggcagtagacttgcacattcatatagctgccaaaaaggtcatgtgccccagttcccactgcagatgcggtcaaggagaataacagacagggggataccttccagagggtgaggacattgcataaaagaactctctccagaaggcataaacagtgcctaatgaagaatttctcctgtccccaaggcaatgtctgcccaatgggattttaaaattgccccaaaccagttgctgtgtttctttttccccttctaaatggaagcgtctattgtggtaattgtaacccttctccaccgttgtaattagatatgtatttattgtctttttagttcataggtctccggagcctggggcatcgcatctagatggaaaggactgaatatcaactgaagagcctaaattttgggctgatgcagtcagtgattaagagttttgggtcagtgatggggcgaatatgtttcatgtgtgggaagataaataaaaggggtgatgcatgaccagaaaggaggactgtggcagaaacagcctagatgctcaccaatcttatttctactgtttgggcagatggaaactgctatagttcaaagcctctcttggagttagattgcaatcatatgaatgagaaatagaatgtgagcgaaactcactggtgtcacttccaaacttggctctttaaatgttcttcacaatcattcatgtactcactctactgtcttatgactattgtacatattcatgcacataatgatgtttccatacatataatgtgtaataatcagatcagggagagtcgcatatctatcagctcaaatgtttatcatttctctgtgttgggaatgttcaatatcttccttctagctatttgaaactatatattattgttaactcctgtcatcctacagtagtatagattattataagttattcctcctatctagctgtaattttatatcctttaacaaatctctccctgtctctcagtaaagtatcctgagatagtggaacttctctggttaacacttggaaaagaattgctgaaaagagccgtctcaccaactttgggctgtgattttgttttgtgaagtcattgtgattttgggatggttgtttatagcagctagcaagtcttagcatggcaaatacagtaactgtcatactaaaaaatatgatgcagaataaattatgttaggtagattaaataaatctatattattaataaataatatttgtaagtctgaattttatctgttggaatgtcagaaaagaatggggattatataaaaaagaattgttagaaaccagagtgtatcctatataggatcattagtgaagaaatagatggaaaagtggaaatgaataactatttcttccacacagaataaaacccagaaacaaagaaaagttaagtagtattagatagtgattcccaagcctgggaatgggagtcagtgatactcacctaggagagaatattaggaaggagtgagtgacatgaaaaaaaagtcacggagggaaagggtaaagttttagtaagtcctatggatgacaattatgtattacctgcagcttgtcctactagaggaatagtctctgtgccaagaggaaaaaaaaaggctcagaatttctgatctaagacataggtaattaagaactcaaaaggaaaaatgtagtcagtgtataagatgatggaaatcttgttttaagagaactgaattattggagaatgtgtaaagaagaaagaggtgttaaacttttgaaggggagtcagatttgctcacatttttaacctttaacagtttcccacttttttttttgaaacggagtttcactcgtgttgcctaggctggagtgcaatggtgcgatctcggctcacagcaacctccacctcccaggttcaagtgattctcctgcctcagcttcccaagtagctgggattacaggcccgtgccaccatacccggctaattttttgtatctttagtagaaacagggtttcaccatgttggccaggctggtctggaactcctggcctcgtgatctgcctgcctcagcctcccaaagtgctgagattacaggcgtgagccacagtgcctggccatactttattctttatgatacaatgtctcactctgttgtccaggctggaatgcagtggcagaatcacaggtcactgcagccttgacctcctgggctaaagtaatcctctaccccagccttccaagtagctgggaccacaggtgtgcaccaccacgcctggctaatttttaaattttttgtaggtatcactatgttgcccaggctggtcttgaactcctgggctcaagcaatcctcccatcttggcttcccaaagtattgggattacaggagtgagccactgtgcctggcctggatgggtaacctttgaaaagttatgtaaaatctgtgtgcctcaatgaggatagtaatagaaacttccctggaattacttgaagtttaaatgagttaatctatgtaaacaacctagaacgggccgggcacagtggctcacgactgtaatcccagcactttaggaggccaaggtgggtggatctcctgaggtcaggagttccagaccagtcaggccaacatggcgaaaccccatctctactaaaaatacaaaaactagctgggggtggtggcacatgcctgtaatccccgctcctcgagaggctaaggcaggagaatagtttgaacacaggaggcagaggttgcagtgagtcgagactgtgccactgcactctagcctgggcagcagagagagactccatctcaaaaaaaaaaaaaaaaaaaaaaaaaaaaaaaaaaaaaaaaaaaaagaacctagaacaatggctggcatagaggcatagaataagcattatatgtattagctatgattacaaaagaggaatctataaggtattctgcagacaaagagaaggaagtggctaatttagtctgcagagtagagaagaaactcagagagctgcaatttgcaaagcaaggaggagagatgaatatttgttttgttttgttttttgagaccaagtttcagtcttgttgcccaggctggaatggaatggcatgatcccggctcactgcaacctctgcctccaggattcaagcgattctcctgcctcagcctcccaagtagctggaattacaggcactcactaccatgcctggctaatttttgtgtttttagtagagacggggttttaccatgttggccaggctggtctcgaactcctgacctcaggtgatccacccgcctcggcctccctaagtgctgggattacaggcatgaaccaccgtgcccagccgagagatgaatattaaaacatatttgagggactttagaaattgtcagtctttaaagtctgtaagaaggatggtctggatgactcctttagcatgaactcattatttagtagatgactccatcccagttagtatttatgcctgtggaaatctcatatgaagagctagatctgatcagcagctctattatatctagcttaatgctcacaatttgttccacaaagccattctctctctctctctgtctttccctccttccattttgttagatcacatattataatagttatatgctttaaacccttatttggaacaataaagatgactgacttacatttcagacattgtcgctccatgtcgctagttttaaaacctgcccaacttagtaataaaaagtaatggctcctcagataagagtttcatgatagtttcttagaaacgagtcaatgacactactgtaatagcaggggaaaagatttctaagtcacatcatattttcaaactgacaattttagctacaaaagtacaacttccaagaggtctttcccaggtaaacatggaagggatttaccagtccacagaaaagtgactgcctctcccttggataaatgagattctttgcttcctgaaaatgagaaactgctatttcaatttcaatgccaaagatcaaattttctgactactgtgaatgaggctgctcagcatttacaacactaaaaacaaagaaaagaaagccgaagaggaacaatttttttttagcatttgccccaggcctttgcaatcaaagcataacccagcttatttttggggtgactacaccctccattctccaggtagttgaatcttccttgcatgtgtgaaagcatcactgacaaagtttcgttgtcatggagtttttagataagtatctctgagtttaaaatcccaaattatatgcatccacccacccttatactataattaatatctgtcttggggctttttagaaataactacacacatcaacagtttcacaactgcttctgtgagtggtgagattagtaggcagatttctaggggaattatgcaggtgaccagtcattaatatgcacattgttaaaatgtttgaacgttgtcatgatgatgatacagcgccgatgagtggaggaacaccaagttcttcgtcctcatgctggtttagataaaacgacactgacacacgtggagtggttttaaggagcggaaagtttaataggcaagaaagaaaagagaaggcagaaggaagaggctctcctgtacagagacagagggaggggggctccaaagccgagagagggaaccccatctggcagggataccagccaggtatatatacagaggctggaggaggcagtgtctgatttgtatagggctcaggggattggtttgacaaagcatgtcattcatatagcccaggaaaaagcctgccctcccaccctagccttttaatatgccaatgcagggcaccatgatgttctacccacgtggggatatgtgggggcggccatgttgccaggaagtgtggggcaaggtcaagatggcagtgggaatagccatgtttgggtggacccagtttctaatggatggcatttgcatatcaaaggttgccagcctggctctaagagctgctttaaaaacgaaaacttcccaaggaccccttttcctctctatctgcctaaaataatttcttaataactcctacaacaatgacaccaaggggccaaattctaagattccaccaacatgatgcagttggcttggcacttcataactcaattaaagggatttttgagggttgttgccttaggtgtacactgcatgctttgaagtttttcctcataaagaacataatgcagtaacttaggagagaccattaaagcatttttccctttaagaactgcagcaataattataatctggtagctactttcttatgttcttgtaagataactagtcatcaacaaatttttttctctattaatttcactgcgatcaaatatttctcaatgaaaataaaagataggaatttcctgtatatatataaactcagttattttgaaacaacacataacattagaattgagaaagaccatggaaatattgatttcagtgtgaatgaaaaagaaaaacttgggaccttaattcactatgccaaaaaagaaaaaaattaagctgaaagatgagtcatgcaagaaactgcctttccttttgttcctaagcagatagctacagataaaagttaaacatctccactgactgctactccatgttcaccttattttatgtaaagtgccgatttactgagcccaagatcaatacttaactgacaattcccctacttgttcattttcctctgcagcttgtggattaccatactctccccttttcccctccagctggcttttcctctttaaatattgaagcctgcaaattcatccttggagaaaggcacagaccacagactgcttctgttattccatgttcatttcttcctggcatgtccttaaccttggcaaaacaaacttctaaatctatttagatcacagaaaggattttttatttctatacttctttaatgtgtttttaaatgtctgcctaatagttcatgcagttgatattccataatctcatcatgattgagtttatttctcagctgtatagaagaggacacaaaggaacagaaaaggcaagtatctcatccaggatttcctagctagtaaaatgaatgcaggaaaaagggaaaggccaagaacagtcacatctatctgtcttttcattttgtttcttcttttgcttttcatgcttagaaattctttctccgcctagagatgagatgaatattcaattatggtttcttccaattgtttctggtgctcatttttatatttatatttaacctaagataatctggaatatattttggtagaacaaataaattagatgtttgttctaagagaagtcttgatgaaatgattaaaaagtttatctataagaattaacagataatacaactgagaaatctttaaaaggaagagtactggaacaggtaacttgtactgacaaaaattgaaactgataatcatcgtaacaattagattagcatgcaccgttttaaggaaaacaagatcaattctatttagcataaaagcagcaattaaaatgatatgaaaatctgtttttctcagacagcatattagtttattaatttagtatttgataattttttcagatacagataatatctaagtgataatttaaaaaaatccaaacatcctaaataaaaatctaagccaaaatctcataacaagcctgtctcttaatgagctgtgacagtgaaataatcctttttacatggtgatagctgatattgtgatagctgtaaacttagctgtcatcacagatcttggctacagaggctgctgtggtaacgagtgaacctaatgggctttgtttacttgagtgaggagttttcttcatgccccaaccctgcctgcttgcaatgtgcatctgaagccaggaggatgtctctccaactgatcgtatatttctttcttgtttttcctttttttttttttttttttgagatggagttttgctcttgttgcccaggctggaatgcaatggcacgatcttggctcactgcagcctctgtctgctgggttcaagcgattctcctacctcagcctcctgagtagctgggattacaggtgcctgccaccacccctggccaattttctgtatttttagtagagacggggtttctccatgttggccagcctggtctcaaactcctggcctcaggtgatccacccttctcagcctcccaaagtgctgggattacaggcatgagccaccgtgcccagccagatcctactatctttctacttttgaattgcaatgtggtttatgtctttggattttaataagcacaaaactcctcctagaattagcaagatatcaaaaaaggcctccaagtggagagcatttggccttgacctcatgtaggaaagaaaggagttggccaggtgtggtggctcctacctgtaatcccagcattttgtgaggcagaggaggatggatcacttgagctcaggagttcgagaccagcctgggcaacacaacaaaaccctgtctccacaaaaagtacaaaaattagatgggcatggtggtgtacgcctgtaatcccagctagtagggtggctgaggcaggtgagttgcttgaacctagaaggcggaggctgcagtgagctgagattgtgccactgcactctggcctgggccacagaatgagacactgtctcaagaaaaaaacaaaacgaaacagggagagtttgaagaacaataattctataattaaagtgtttttagaatagccctcaaggatcctctttctatcttttatactaccaaacctataaacatatatgtggtttccaggatgaggaacacaatacttgagatggaaaactaaagaccggctatgagctccaaggttgaggaacatatttgctgaacccttttccttaaattacatttatagaaataggaaaaatggaatatctccattaggcataatttaaaagcactgaagaagtgtagggatgtgaaaacacttctaaaaaagcaagcttggcaaaataccaacttttctcgaggaaccaatccattctatttttctgtttgtttgtcccaggttcttaagcagcatctgatttctaaactcttacaagggtagtctggataaagcacgttttattttctctgttgaaaactaagtattgcttaaatggagaatcatgccttatttggtagtacgcaaaggtttaaggcattttttttccttagatgagggatatcaatacagaaaagtctgtcactctgttttaaaatttatataagctcaaagtttcaagtgctagttcatgggggaaagaatttgtttattttttgtttttgcattttctatgacatcttttagcataaagccttacagagatcatttttttaaatagtagaaacataaatgcttattgaactgagcactctagccaaggaaaaacttttcattaattttgagataagaggcaaaaatgaaagcatattataaaccttactgattatttcttccttactttggctattggccatcttttagttgaagcatatacatttattaaatgtattaataaatacattaaattaataaagtcccatattaaagaagtttatggaaagatctctccttatgtcttagtgttctcttccaggaagagggtatacagactttatagaaagtagatattccctcttatcttgtaatatatgtccttgtgcagcatgagaagaaaactttaagatcacagactagcctaagaaaaatgatttatctttcagcaaatatttctcatccataatttactttggcttacttctgtgtctacaagtgtctgttgtagcatataaatgaaactagtttcaaacaacttttcaggtgcaataacaaaatgtatgtaccagagcttctggatagctgaacacatgtcagttcctggagggcggtgtgcccagggatggcatggaagctctgtgccccttcccctatgtctcaccctatgcacctcttcatctgtatcttttgtaatatcttttatttactttttttttttagagacaaggtcttgctctgtcacccaggatggagtgaagtggtgcgatctgggctcactacaacctcctcctcccaagttcaagcaattctcctgcctcagcctcccaagtagctgggattaccggcatacaccaccatgcctggccaattattgtatttttaatagaaacggcatttttacagtgttggccaggctggtctcgaactcctgacatcaagctatccgcctgcctcggcctcccaaagtgttgggattacaggcatgagccaccgcacctagcctgcaatatcttttacaataaaccagtagatgtaagcatttccctgagttctgtgggctgttccagcaaattaactgaacccaaaaaaggggtcatgggaactgcaacttgaagcgcggtggtcagaagttccagaggcccagacttgcaactggtttgtgtgtagttggcagtcttggggatggagccctcagtttgtggaatctgactctatctctgggtagataggattggaatggaactaaagaacatccagctggtgtctgccgcttggtgtgttaggaaaaaactccatgcatttggtcatagaattcttcttctgtgttgatgactgttgtgttgtcagaggagagagaaaacacagttagggagagttcccctacacaattgatgtcagtgaaatgggatttgctagaacagccctcactcacagaaacatgtggtttaggaagagaaaggctaaaaggctgggaggatgaggaatctttgattcctgggtgaccatcgtggtcacccatgatatgaagttgcagttgtgttgagatcagttactacaggtgaaagttaccagcggaatttagagatggatagaactccccaggaattggttcactggatgcaaaagggaatgcaaactaataagaaaaaagcaaaatattcagttctttggttgttgttacttaaaattgctaaaatgaaagtaaaatagggtgctgcatcaggacttgaagttggaccaagttcagatggggacatgtctgagcttagttaggccactagcctcaaagtcacacacaaaggagaaaattatgcagggacagtagaaagtacctctgaaacctgtggaagacagtcaatgtgaaggcagggcaaaaccaagtaactatttaaactattagagtaggtagttaggtaggcatgagcaggacaggagcgaggccccatccagaaatgccaggcaaccatcaggtgatggttagttggttgttaaactgttgctctaaaataataattgttcacagccaatgcagggaaaaacagtctcccaataaatagacaatacctgaaactggtgatcagcagcttcctgataagatttcaggagttgggtgaacaggctcaagaatgcccactaaaaagcaaaatggcagagattaactggtatatgatctttctctaggaaaacttgactggtaaggaaaaaatgcctcaaatgagcatgtgtacaactttggcaaacacagtgtgcatgttgcccctccccaagtgctggcggaccagtgtgcatgcagatagcccaccccaagggaagaatcaggggagaagaaatgcaaaccttggaacgatgccaatgtattctttcctccttgcaggcaagaatcgtttgctgcagacctgttggattcacagctggtaacaaaaccggagagtatagtgtgaaggaattgtttcatttttgtagaatggtgttatcagcttcctgaggaactattgctaaaatggattataagaatgacaaatgtaggggcagtgtctttggtttcaaatcttgcagagtgaagagcatgtttgggttgatataggacccacagctgaccatttgaacaatcacagatgggtatatatgatccagatatgtaggttattccgcaaggaacagccagtctgatagattggataaaagccattataagatctatttgagaaggtggactgttgaactccacctataaatgccaagtggaacaccttacataaggcagctgatacaattcatatgcaagccatgtgtgactggctttatgaggacatgaatattcactcagtgaatatgtccattacccaggtcacggtaaatactctggttaaggggaccccatgtgacattactcctgcagactcaaatagttcaagaagccttatcaaatttgtggactgagtttcccctcatggatctcacagatgctaataaaaacattaggttaattaataagagaacagtgaaaggcaaaagggagagtcaaagactcatccccggaagatagaaattttaaaatggttattaaaaaataaggtgaatgaagaaaacattgatggggtgaaactaagaagaaaaagaaaggggagagtcatgggactcgtcccagcagaatggaaaactttagatgcttattaagaaatagaatcaataaaatagacattgatggggttaagcaaaggtcttaatacaacactattgtaggttggatggaccagagggggccccatcttgttccccaacattaaaaggccgcaaaccagtctgctgtatttctgccagcttggagaaatttaaaaagctggaaggcagagattacaatgaaaaatcagatctaaaattgcctggggcaacagtcaggcagactaatcgagataaagattaataaaagggccagggtccttgggctcaatccttggctggggacccaaagctttttacacaagagagggtaaaatgacctgggggtaaagaagagaagatcctgaaactagaacataaaaatgtaagagttgataggactatggaagttggtatatttgaaaacactttatgtgaagtgattgcatctcttttacctgatttttttttttgtgggaatgaacaaagtatctcattgggaaatatttctcctccctggtgctgtaaaacagaaggcatgtaataatctgccctcaagcaatattaattggacatgctaaatgggaaccagtgagattgcccaagtccacacagtgcagagtagaagctagaatgctgttatggataaattctccacttgataagcctctgtgatgctatttcctggatcttgtggcaaaagcctctgagcacctcccagcaacatctactgggactttggactatggaacttccatctgaggggcatttactgctttgctgtgaaatgttaggtgaagctaccgctattaacacctgaaatacccatgttggcccagcgatgtcagagaaacattctaacagggatggcagtgcccaggagagttccataataaaatggacatggtttatcgaggatcatgccacctaagaactgcaaggaggggatactcttgagcagggtgtttcttttctcctgagactgactctggaactgtgtgagaaactgctggattctacagtgcctgataaatggctctcaactcatgagaaagagctacttagtttgtggccggtaattccaaggtaaatggacaccattgtgtttggaaggcagctactttgataaaagaaggtaaaaacagatctgcttggtgggctgaattgcacactgtttttctaacagtgatggaagaattgatcaatggtaaaagcccctgagtttgggtgtttactgagctgtgggcagtgtgacccatggcctggccatacactcaggcaagagggccatggaaatttggcctattaaatggatgcacataggagcactgttctatggagatttgaggggtgcattaaagaagaacaagtgaatgcccatcagaagaactcccttccaggttcagaaagtgactggaattgacaagcagatatccccatgtactcccttgaagtggccacctgggcctttgaaatgagtggatatgggggtattgtaacagggcagagatgggctgaatgtagagatggtttttttgcaccttctcaggcacaaaatgccagaaagaactgttgtgtttctcaataagaaagccagagactgctgacggctttgggacagattctctggtgggaaggccctgaacatagctggcaagtgcgacaaatgctggtagccctggaggctacaaatgggtcttgacaggaatagacactggctatggagtggatgttgcttgcccagaagaagatgaaaattctctgagtgccataaaaaaccggaacagaagatattacatggatatagatggctaaccatcagtttttcagaccaaggaacacactgtacagcccataagaatagtccaacaatggacaaagagatatccacctagagtaatagtttgatagagcagtagagcaggcaattgaaacattgattgtgtaaaacagggggagataaaagcacaaagggctggctcacatgccttcctgtctgctcacactcaacatgagcaggactagagtgtttctgctagattttttttctttgtttttctggttgatctggggaacagggagttgggaggatgctggtatgactatgccattcttgccaagggacgagtacactggtataacaaatgtaagtttttctttcttccccaaatcacctaaaagaaatttatttttttctcccctggctgatgcagtggtcctaggaccaggactgcaattacaactgctggattagcaggggtgatttctaagcaaaaacctgtaactgtgttttgaaaccttatatcaaaattcccaaaggcatgatgggagtgggttgtgtcttcatgctatctagaaaaattggggctatcagtgaatgcagctatattgcctggtggtaaaaatagctcactagttctgcacctatgtaaccttacccggtctgaattggcgtggactgaggaggagctaattgctagacttgtattactacttgcaacgtagaccggcactgtggtggttctaatttctcttccaaaggtgaaaaggtttaggtattaatggagagaaggagaaatagtagctgagagtaaataaatgaataaatgagttattaattgagaaaaattcagtattacataacaactcaaaagagtctcagagcaagagatgacattgtctcttagcttaattatcccagatgccttaaagggtgaagctgcgtatttactgaggccactcctgctttcgagacctgacaagattgagaggaaacttgcaaccctgagtggcctcatcctggaagacattcaaacaatatgaaggatttgattaattgttaatgattgtgcataatatatatatttttgaagtaaaggcaccatggtggaaaaccagggagtggcctgtggtgttatgatatacactggttttagtccacagttcctggcttataactcctatatcccttgttacaatattttcttttttttatataatgttgggtatgttaggcctcaggagcaagcctctgaccttctcctgccttactttcactctaatgtttccccactttctaattgtgacgcttaagactctcacaggagagggttccatcctatatcctgagggaaggaatgctgatgtcatgaagctttcataaaaacccaagaggacagggttcagtgagcttccggatagctgaacatgtggcacttcctggagggtggcgcacccagggagggcatggaagctccgggccccttccttcataccttcccctatggttctcttcatctggatcctttgcaatatcctttataataaaccagtacatgtaagaaaaaaaaaaaaaatgtacttacagtttccttccttccttccttctccttccttccttccttccctccctccctccctccctccctccctccctccctcctttctttctttctttctttcttccttccttccttccttccttccttccttccttcttccttccttccttccttttctttcctctctctctttctgacaaactctcgcactgtcaccaggctggagtgcagtggcatgatcttggctcactgcaactcctacctcctgggttcaagctattctcctgcctcaacctcccaagtagctgtgactataggcacatgccaccaagcccagctaattttttttgtatttttagtagagacggggtttcaccatgttggccaggatggtctcatctcttgaccttgtgatccacctgcctcggcctcccaaagtgctgggattacaggcgtgagccaccatgcctggccaacctacagtattttttctaaggccatctctagctgcatacttaccacactaggtaaattttctgtaaaggcatatgccataaatcaggatttttttgttgtggttttttggtcaagattagtttctacatatcatccagtatttgttacgtctaatgagaggttgtatatatacatgtgaatgtttcaggaccatatggcaattattccatttaaaatattgctgtcctacttctcagaaaaaaggcaaggcataaattattgtttttactattttaaaaaatgtagcccttcatcagagcttagatctataggtataaattactaatgctcatccctttccagtggcaaaaaggagatatcaaattattttgagatttgagtaagaataaaattaataaatagcaagaggacaggtgtgtgaaagttttcatatgagtaacgctcgggttacttatttctttccttttaacaagaattatttagcccttgcctggctcttgctgcagtcaatttgagaggaaaggacatcttgccattgattttaattattcccagtcatcccattccttttttagtagattgaaactctcttgggctggttttctagctccacctacgtattggttggcactgtcttcatttaattttgcctgttattattccttcataatgcctttccctgaagtgacagaacatccttcacctgccaaggtcagcagtttgctacaggagatgacacttccaggatcatatgccaagtctatgtaagggcacaagcgaacggtggtggtaactaatagtcttaaagttatcttgtttattcttatttcagctttcctgctatattttttgcatactctctaaagtaatacatggtaattggaaaaatgtgagaagataaaaaagaaaatcagagagaatgagattgtgtattaattagttatcaccaaacaaaactccagactgtataaataccaaacaaactccagactgtataaaaagtaaaaacaggaaataatcatttcaaaatttcattggattaatgttttctattcctgcattcttccccctccttcttacctcttcctcctcatctttcttcttttccccatgtcaagtaatttccaagatggcccaggaataaagatatgcagttacaaaacattctagccctaactagtaagaacaaatattctctttctgtgaatagaaaggatagatggatctgtatatacacagacttgcatgtgagtttttagaatatgtacatcagttagattgtgttaaggcacaaagccatagagttatgccccacattaggaaatacttccaggaatgtgtattgcatgaataaataaatgaaccaatagcttactatgtgtcagattctttgctgtcctttaaatagatgatcttattgaatcttttccccatattaggaaatacttctaggaataagtattgcatgaataaatgatgaaccaatagcttactatgtgtcagattctttgctgtcctttaaatagatgatcttgttgaaaattcactgtgaaaagaatggggatctagcatgataaaaagatacttgttgactttatggcaggacacaagttacacattttgcagacttaagagaggctgtgtggcctgaattttgaagtagtacctactgctatagtagtgggcactcagattttgtagaattaggcttatcagaaatcctcagtttaattgtacattctatgcacttaatatttgagatttgttacattgtattggtgtctaatattttattcattccctatgagtgccagaaaaggagtgaaggtagagaatatttcatttgtcagtattccatgaaactactgattatgggaaattcatgaaagagcttacagtttaaaattctacaatggattaattaaatatatatatctgattacagctgaagttcaagtccctcagatcaatcagcagtattttcagagataagtagatttatttcttaattaattaattaatatttatgtgtctattaaatatggttcttcattgcacatactttgaaattttttttcttttttagagagagtgtcttgctctgtcacctaggctggagtgcagtggcgcaacctaggctcactgcaacctctgcctcccaggttcaagcaattctcatgcctcagcctccagaatagctgggattacaggcacgtgccaccatgcccagctaagttttatatttttagtagagatggggtttcactgtgttggccaggctggtctcaaactcgcaacttcaggtgatctgcccacctcggcctcccaaagtgctgggattgcaggcatgagccatcacacctggcccatactttgatatttttaaccatcaaattagtgaataaattactgaataaaacttaaccatatctcttccatgggtagggagactatggcatcacaaaggaacagtgttgttatatctttacaataggaaacattggacaaagatggaagagtaaggacaatgttatcattttcattgttccatcatcataatgtgccatgttgtgtatagacttctctacactgtgtggctgcttctttggaatacacagtcctaagcattgctgggattgtgaatgtcaaactactactatagatattttgtatctcagaacttaaacttgatgcagtaattattgtcttaatcattggttttacccttcctatcattgtgttggaataaggtctttcctgaagtgagtactataagcaatagtatagaaatacacaagagacaataaagtacgtgaggaaggctgggcacagtgggtcacacctgtaatcccagcactttgggaggctgaggcgggtagatcacctgaggtcaggagttcaagaccatcctgaccaacatggtgaaaccctgtctctactaaaaatacaaaaattagctgggtgtggtagcatgtgcctgtaatcccagctacttgggaggctgaggcaggagaatcacttgaatttgggaggtggaggttgcagtgagccaagattgtggcattgcactccagcttgggtaacagagtgagacattatgtatatatatatgtgtatataaatatatatgtatgtatgtgaggaggataatagttaatcctaacagattaacttggaatcattcaataagtagactgaactaaaattgggaagccattatttggtattaaattatgggcaccaggggtaaatgactgactaatagagcaggaaacaccagacagagaaaggaatgaaatacaaatgatggtcagtagggaggaggtggtcaaggaaaatgagttatgaacagaaagaactctatttacaggctgacactataaatgcttgtaaatgaaaaataaaattctaaggcctccagtgaactgaatggaaccctcatcttggccaagggtattccaaagttaacctgaaacactagttcaagccatgacgggaatgagtggtcagacatgcctcattataccctcgtcctgttggaattcagtcactactgaccagcattaacattaaaacagagaccttggccggatgcggtggctcacacctgtaatcccagcacccgcctcagcactttgggaggctgaggcgggtggatcacgaggtcaggagttcaagacctgcctggccaagatggtgaaaccccgtctctactaaaaatacaaaaattagccgggcatggtggtgggcacctgtaatcccagctactcgggaggctgaggcagagaattgcttgaacccaggaggcggaggttgcagtgagccaagatcgtgccactgcactccagcctgggtgacagagggagactctgtctcaaaaaaaaaaaaaaaaacagagtccttaagacaacgaagggagacactgtagcaataagagaccaacatagcagacagcaggccctgaagaaaactgaaatattttaccccaagatatatttctttgacatattttgaaatggccctgcaatggtgtctgttgtggggaaaatccatattctgtaaagaattcccttccttttccaagtctttttcctgatccaggagagaattaactaagaatttggcacctttttaagtctgatgagaaatatttacagtgtattctctctgaagcctcccatctggaggctttatctgcataataaaagccttgatctccacaacaaccgcttttcttaacccagacactcccttctattgattccacgcctttagataaactcttcaactgtgaatccacctatgacctgaaatcccactccccacaagccctcccaaccaagttgagttgtcccacctttccagaccaaaccaatatacatcttacatgtattgattgatgttttatgtctccttaaaatgtataaaaccaagctgtagctgaccaccttgggcacatgttctcaggactcctaaggttgtgtcacgggtatgtttttgaccttggcaaaataaacttctaaattgtttgggaactgtctcaaataccctttgggttactccctgaactatgccagaaaatcattgacattgtgaagggaaaatatcttgggtcccccaaatcactaagctaaagggaaaagttaaggttgggaacctcttagggaaacctgcctcccactctattcagtcacccctcttctcactgagataagcgcatatctgattgcctcctttggagaggctgatcacaaactcaaaagaatgcaaccatttgtctcttatctacttatgacctggaagccccctccaagcttccagttgtcctgcctttccagaccgaaatgatgttcatcttacatatgttgattgatgtctcatgtctccctgaaatgtataaatccaaactgctctgactgccttgggacatgtcatcagaacttcctgaggctgtcatgggctcacatcctcaaccatggcaaaataagctttctgaattaactgagacctgtctcataatttgggggttcatgttttggtaaccacagagggattctaagtagaggtgcccctgacctttgacaaatctccttttggtgtttggtatcagcttgagctatctttatggctcaaaccaataggataatttgctgaggtctggaagcaccctctccagagaatccctgatcttccaaaatttggttgagatctacagtttattttggtacgtaactcctttttttgaattttacttgcttccaacccaaggaaggcaagttttccctgcttccataatgatggaaggcagataactcctttatggagtttgagctcacttccaacagggaagatgagtttttgttgttgtttgtttatttgttttgagacagagtcttgctctgtcacccaggctggagtgcagtggcacgatctcagctcactgcaatctctgcctcctgggttcaagtgattctcctacctcagcctcctgagtagctgggactataggcgttcaccaccatgcccagctaattttttatttttagtagagacagggtttcaacatgttggttaggctggtcttgaactactaacctcaagtgatctgcctgccctggcctcccaaaatgctggggttaccggtgtgagccaccgcacccagcctgatgagatcccctccgctgccccctacttctaggatggtagagagcagccttcagcctgaaatccatccctaggcaagtaaatgatgtcaggcctctgagcccaagctaagccatcgtatcccctgtgacttgcacatacacatcccggtggccggttcctgccttaactgatgacattccaccacaaaagaagtgaaaatggcctgtttctgccttaactgatgacattgtcttgtgaaattccttatcctggctcaaaagctcccctactgagcaccttgtgatcccccactctgcccgccagcgaacaacccccctttgactgtaattttcctttatctacccaaatcctataaaacggtcccacccttatctcccttcgctgactctcttttcagactcagcccgcctgcacccaggtgaaataaacagccatgttgctcacacaaagcctgtttggtggtctcttcacacggatgcacatgaaaaatgaagtggggtttgtcttggttaaagttaagatttccaaccgcctgatcttaatttctccttaccattagagtgcttggtaatcatgtaagttgtgcaattgtttgttttgcttaacttttgttttgttattgttttttgtttctggtttttgttgttgtttcagtctttttctcattgggtttgatcaactctatccaactagatcaaatccaaaggaagttccaaattatggaacaaggcctctgaagtggctaaattcccagaaaaacgacgacaacaacaacagcaacaacaactacaaaaacggtggtgtggtagcagagaaatataccagcaaaaggaaaaaaaagaggaaaggctttgattttgactactaataggctttatttacatagcaaggtggcctttttgctaatcaggccaaactgaaagagcaatggctattacttctgaaatagcagcaatttgtcctagctgaaatatggtaatgatatttaaaaacatattttttaaaggggctcagtggctagtcagcttaattaaaagctaacatccaagatgtgtgtgtgtatgtgtgcatatgtgtgtgtttgtatttaaaagaccctcatgcttttgtttttgcttttctcctaggaccttgtctctttttcgagcaaaagttttttcttctcagttgactgaattctgttttcttcacttgtttgtttctgctctctctcctttctcttgcaccctctgctgcatggggaacctaaaatagttcgtaatagcctggggttccttaaagaaaacagtgaaggcaccagactcccttcggaggagaaacctgtttttccttatggaaccccaagaatgcaaacagacaaggtcctctcagctcttaaactgcttactttttttcactcacgtccgtgtgaagagaccaccaaacaggctttgtgtgagcaacaaggctgtttatttcacctgggtgcaggtgggctgagtccgaaaagagtcagcgaaggcagataggggtggggccgttttataagatttgggtaggtaaaggaaaaagggaggttgttctctggcgggcaggggtgggggtcacaaagtgctcagcgggggagcttttgagccaggaggagccaggagaaggaatttcacaaggtaatgtcatcagttaaggcaggaacaggccattttcacttcttttgtggtggaatgtcatcagttaaggcaggaaccagccatctggatgtgtatgtgcaggtcacaggggatatgatgtcttagcttgggctcagaggcctgacacttttgtattgtgttacctggttttttgtttttgtttttggctaacatagttattgcaacagagtttgctcttgggtttttaaggaagagtgtgttttagacactagaaatgtctttgcttaaaaaaaatttttctaagtgcacttaaaaaaacttaaaaaagtatcatgtggtctaaccttattataattctcccattctggagaccctggaatcagtgtgggctctgcccacagctcagggatccagttaaaagataggtagttcctatctaaataaaactggtctccttatccaatcttacgatagatttctgtaattttatgtttgatttggcatctatctttaatctccctctagcatcaccagactttttctctcagtaccttgtgatgtaaattttgctatttgcatttcacctgagtcgtttcctttaatttgcaaatttaagcgtgtttacctgacaactgcctagggttgtgaaacagattatcaaaaatctgaaagtctaagatagggaaaaaaaggtttttataaatctataagatgtaatttatcagcatgcctaatatgtctatgtatttatatgttatgtacagaatgtttcactactcaaaatagataaaagagctctaattaattggcttaagaaaacaaaaatgcttgaatcaaatactttattggaaaaaagaaaagactagtcaaatgcttattcaagtttatgtaacttaagtaaaatctttaataaataagctagctttaaaattattggtaaagtaatattagaaatgtcttaagaattgccagcatacatttttgttttgtatttattaatcaagcaatttcatacttatccctgtcaaatgctatgaggtgtcaaaatttggcatagtggttacaaaactataaaaccagcccaagaaaatgatctttccctgtgtaatctttaaataaattagagattgatattggtgtaataagctacatcattttattttatttatttatttatttgtgtttttttgagacagtcttgctctgtcaccgaggctggagtgcagtggcacgatctcggctcactgcaacctccacctcccaagttcaagtgattctcctgcctcagcctgagcctcctgcctcagtccggagtagctgggactacaggcgcatgccaccacacggagctaattttttgtagttttagtagagatggggtttcaccttgttagccagggtgatctcaatatccttacttcgtgatccgcccacctcggtcttccaaagtgctgggattacagtcatgaaccaccatgccctgcctttatttactttttttgagactgagtctcactctgtcaccgaggctgtagtgcagtggcatgatctcagctcactgcaacctctgcctcttgggttcaagtgattctcatgcctcagcctcccaagtagctgggattacaggcatgtgccgccgttcccagataatttttgtattttttgtatagacagggtttcgccatgttagccaggctggactcaaactcctgggctcatatgatttgcccgcttcagcctcccaaagtgctgggattataagcaggagccaccaagccctgccaacatcttgaatttagtaagattactgtgacttctaatcttgtggcttttgtcggtctagtccacaggcagtaaggtttgttttgggaaaggactgttatcatctttctttcaaagctaaactataaactaagttcttcccaaagttagttcaaacttttatcaaagccaatttaaaagcctatgtaaaaaaataattattcttgctgagctgtatacaaataatttggccaagtatcataaagcaaatgaatcctatcatgatttgtcttgagtaaaaattaaaaactggagagagaataactgtgtttcaaaacctatactatacctgttgttagattctaggtcttgcctaatgtttttcaatttttattattttctacagtttggaccaaattctaatttttcttggctacaagtcttcaaaataatgttctcatttttttcttcttttttttccccacttttcctaatttggagtcactgaaaactaagctgtgctttcgtaaagccctgtgaactgaagctagacaactcgaacttcagaagaaaataacagcaacctatttacatacataagccactttcctacctgcctccaatgtaaggatttcagagtaatgtggcctatatcaattttccaggattgttcttttgcttattgttgtttttctcccttcctccccctattttatctttaaaggatatgaagcttcacaacttctaaaaaatgagctttcctaataactcaggacctatctgcctaggaataacccattgtacccatgagaaattagaggaaatctgagatcagagactcattttcttttaacatgttttctccaaagattttaaaaaagaaaaggggggaaatgtgagagaaaaatatcctgcccccccaaggttactaaactaaagggaaaagtcaagctgggaactgcttagggcaaacttgcctcccattctattcaaagtcaccccttgctcactgagataaatgcaaatctgattgtctcctttggagaggctaattagaaactcagaagaatgcaaccatttgtctcttatctatgtatgacccggaagtcccctccaagcttccagttgtcctgcctttccagaatgaaacaatgttcatcttacctatgttgattgatgtctcatgtctccctgaaatgtataaaaccaaactgtgctctgaccaccttgggcacatgtcatcaggacctcctgagactgtgtcacgggagcaagtcctcagcactggcaaacttactaaattgactgagacctgtcttagatttttggggttcacaacattcattagcgattgggggtctaggactgaaatttaaaggcatagatgaagtctgacagatccaatctgatgttaactttgggattttctttagttaccactcagtgccccagtcctccttaaaatactttatacctccaagtctctttccttccataaaagccaattgtttctctaacactaggtctctgccttgctgttacctgccttcagaacctggggtcttcccttcatagttagggttcccaccagctaagaattcacggcctggatctctgcatattgcctatgctcagattgccttgctgccatgtcccacctatcctgtcacacttttctcacctggagtttgatggtttccttgtcactcttcctcccttgcagtgtgctctactttgcttctctgggcagacccttgcataatcctgggtctgcccctatatgcctctagtaggagttgatgctgggcttgtattttggatagtcccaatggtaaataaaccctgactgtcgttcattcatctgtcaaatatcattatgctctaccatgtattaagcattatgctaggcacttgagatataatgagagaaataaccatggaggaacacaggaactctcatacattgctgcaatttggcagtatattgtaaagttgaacaggtacatgccctactctgcagctaattaatgtctcggtatctacctataaagactcttgtttctcctcatttacttcatttgcttttctttcatttacaacatattatgtaggacatactttttttttttttttttttttttttgagatggagtctctctctgtccctcaggctggagtgcagtggagcaatctgggcttactgtaaccgctacctcctgagctcaagtaaggtggaggttgcagtgagcccagatcctcctgcctcagccttctgagtagctgggattataggcacatgccaccaagcctggctccggtacatgacttcaggtgatcctgacctcagatgacccacccacctcggcctcccaaagtgctgggattacaggcatgagtcactgtgtctggctgagcatgcaaaatttgtaatcggtagacattgtttataggcatgtttcataattataaaatgaattaaaaatcagtcacataaatatatgggctttttcaaaataacccaacatggaaaccttgatatccttccctagatctatggcagtctttgtagtctccatgacattgcacagcttgggttcagaaatgactctctagaaaaactgaaacaccacacctctgtagataatgatgtgcagctggggctcagccacttgtgttagtgaagttcctttcacaccaaagatactcaccccacttccatattatatccaatcatagtatttcaacttctgtcaaaattcccagtctccaactatggtgcagcagatcctttcaaatgtaaatacaatagcataaacttatatactgacaattctgtaacatacagaatttcattctgtatgattctatttaatagagtttcaaaatattcatatggatgaccataaaagaaagtaagattaaagatgtgctctttatgaaaaggtgtaacccacatttcaatcagggatactttataatctttaaaaaacacaccattgaccaggtgcggtgactcatgcctgtaatcccagcactgtgggaggctgaggcaggtgaatcacctgaggtcaggagttcaagaccagcctggccaacatggtgaaaccccatctccactaaaaatacaaaaatgctagccaggcatggtggcaggtgcctgtaattccagctaccagggaggctgaggcaggagaatcacttgaacctaggaggcggaggctgcagtgagccaagattgcaccactgcactccaggctgggtgacagagtgagactctgtctcaaaacaaacaatcaaacagccacaccatcggccaggcgcagtggctcatgcctgtaatcccagtactttggaggttgaggtgggcagatcccttgaggccaggagtttgagatcagcctgggcaacatggtgaaacccagtctctactgaaaatacaaaaattagccgggcatgatggtgcatgcctgtaacccagctactagggaggctgaggcacaagaatcacttgaacctgggaagtggaggttgcactgagccgaacttgcgccactgcactccagtctgggcaacagagatagacgctgtctcaaaaaaacccaaaaaaccaaaaacaaacaaacatacaaacaaaaaacaccattgtttttatttgtattttttccctatttactacttccacaggaaaattgtttgatttttgctctattttaagccaaacttcatatgcagggtaaggctgaggcaaaacaagtgagaaagtggttgtagataaatgtaaacgaatgaccatgagatgaccctttcagaacttgtgcaacacgtatgtcaccagccccattagcctgtgttaggaataacgttcaaaatcctaaggaaattgaacactcgaacaaaggattcttagcaaagcaattttacttctgcgcacaggggtgcctccttggccagttacatgagagcacacctgaacaaaggggcaggggaacctttatttctgtcgcaagtcctgccccgtacgctttttttattggccagggtcgggtcgtacaatttaaactaatctcggttggctaagcatttgattttttttagatagggtgggcacgtacaagaaagtggagaggaaggctggacgcggtggctcacgcctgtaatcccagcactttgggaggccgaggcgggcagaacacgaggtcaggagattgagaccatcctggctaacacggtgaaacctcgtctctactaaaaatacaaaaaaattagtcgggcgcctgtagtcccagctactagggaggcggaggcaggagaatgacgtgaacccaggaggcggagcttgcagcgagccaagattgcgccactgcactctagcctgggggacagagggagactccgtctaaaaaaaaaaaaaaaaaaaaaaaaaaaaataaaggaagtggagaggaaggggaagggttgtctgcaatgagctagaaagttagtctttttttttttttttaaataaggaaaggaatgcgaggtggtactgataatgcctggtactgtagcgtgcctgggcattaaaggagaaaaacggaaaaacggcgggggtactatgaattaaagaataaaagattgatcagattatttgaagagaaaccgcatcatatcccacacctgtcactacataatgaggttatgcttcatttttatatgtatataattatgaaaaaagactctgtctgtttgcttaccagatgttagcatgtatttttctacaacattgtttggagcgtttcctagagtactgcttggctttttgttcaggagccttgctgcagctgggtccttccttgcagccttcccaccctgctgactgacaggatgctacctttattgctgctgatgtttatcagactgatactctgcctctaattgcaactggcattgtctctccagctcacaggaggggaaactgttcttgtaattcttcgtaatacagttgaggcccggctaggaccttggccaggcttgggagtcatagggtttgcaaactcaaatgtcaacagaagtctggctggtaatggaagcgtgaaggctgcatagtttaagaaatgtgggcatgccatttggctttaatgttaggaaataacagccagtggccaggcgcagtggctcacgactgtaaccccagcgttttgggaggccgagatgggcggatcacgaagtcaggagatcgagatcatcctggctaacatggtgaaaccccgtctctactaaaaatacaaaaaaattagctgggcatggtggcaggcacctgtagtcccagctactcgggaggctgaggcaggagaatggcgtggacccgggaggcggagcttgcagtgagctgagatcacgccactgcactccagcctaggcgacagagcgaggctccgtctcaaaaaaaaaaaaaaaagaaaaaaaaagaaaagaaaagaaaagaaataacagccagtatgagtgaactgacgacgacatactgcatttaaagggagaagctgctattcaaagccaactgattgttgatatatggaaacagggcttagtttttccagttacgattttgcaaaagaactctgcaatttatattttttaagggaaatattcttatttttcaatactggcaactaattctttttttttttttttttaaagaaagtgctgtggccaaaccaaatatttctgtgggcctccatagaactatgaaacactaatctatgaccattgactaacaactgctaccggaagtagttacttgctactcccaggactcacagtccaactatcttttagattccctgcatagcaaccggcagacctccatgtagcatgagctgacacagacagacatacagacatacacacacacacatgcacacgcacatttacagagtgcatatgaatgaaaatcccatttatatcaggagaaaaacccacatcctccccaatattggtgttgggctccacagactactcaaagccatcactgtggtttgcccatttagtctcaaataacactttatgtggaagagaaatgttacattatagtccatatgccactgcgtcaaatccaatgcactttgcattcaatcttgccttcaggatgaggtaaagaaaagttgctactgtatgcatggcataatctcatctcctatctcctggaagcaaatggttaaacaaaaattataaacacaacttccaagaacaaaatagtaattttcagtagcaagtagcctgaattcagatttaagataaactatgtctaactctgtggaggttcagcctggctaataaatcaaatttacattaaggtcagggctctggtgggactattcccttatattcaggagtgtcttcaagaataatggaaagctacttgagtacaagagtaaaagggcccactcaatttccacatcagaatgcgggaaaaccacatgccatattctcattggaaacttctcctgcttcaaaatttaaagttcattctgcaccagataatccatttgattaaaagaaaacaacttctgagggctaacctgttaaataagcccacatccaaagtcatcttaaaggtgactatcagagcaataaaatgaaacagtaaccctgcttgaaggcaaaacaaatttgaagaacaattcagccagaggtagagtcttgaagtctaacaccagctgtaagaaatgaacactatgctggagaagaggtgagagatcaggctaccttgtttttgagtaacctagcatgtagatatctattgtgcaggaagatgtatcaggtaccttggaattacagaactaatgtctatggtgctgaatttatgctaagaaatattctgataatttaattttcccattaagaaaaagtttgctggtcaacctgaaaaatatggtctatttggccagattgacaatatttctcattataaattaacaaataagttttctggttatatactttagttacacaaatatattgtgtaattgtatgatatgattacattgagagggtctaaatattttatatacttaagaaatattaggtaagttgattttaaataggcattacagatggcaacataagtaaattaaaatatcaccttatacagtcaactcatttttaacttttctttattcatgcactggaaacatgcatttttatttttatttctcaaactattttttaagattaaatgaattcatttttctttacctgcagaaaattgccctgtcattaagaaagaggaagaagagaacattcatatttattgacagcattgtttggcctcttatatatataaaatgtcatttgttttgcacaataaccctggggaaaaaaggtattctccctgtgtaataaaaataggttgaggcatgtttagtaaaacatgccctaggtcacacagctagtaaattgtgggctaagatgactcttttattctttatgatttttttattggcacattgtagcctaaaattctaaaagaacatataatcttgtgtgctactaaaaattttaatctgctctacccaaggtttaagtagtatttgaatgagccagattgggagaggccgtgactcagtcagagtcagactgtcagacttgcagtgttgtttggaaagatgggtttctgagatgggcattaggccagggacatcaggcttcaagtaaatctaaaatctaggagattattctttgtagggtagaggagacgcaaaggacataggcttaaaataagcatattaacctgtgcagctgcattaatgagtgcggcttcaaaagaatctcttcagtaacagagaaaataatgactatattcatacatagtaggccattgacagaagacccaggaataagatcagccatatattgtatctgaaatatggctaaagtgtaattaaatatttaatattaaactaaactcatatagaactgggaaataagaccatcaaattctcagttattgttatctctgaaagtggctttgtttagttgataatttgactagggttagaattataggtccaaatatatacatatatatatatacacacacacacgtatatatatatatatatatatatatataccgtgtatatatatatatatatatatataccgtgtatatatatatatatatatatatacactttttttccaactcaatattttgctcaagtgtttaattgcaagtagtatgctgatgaaaaatctgttgttaatcttgttcttattttcctgtaaggaatctttcttttctctctagcagtgtcagaaatttcctttttatacttagtattctaagatttcaccatcttgtacctgtctttttaattttgcatggctttcactgacccattatgtagtttcatgtctttataaagttctggacaattttaggctattacctcctgaaatattttttccctacattctgtctaaatctattgaaaagagttacgagtgggtaggtaatttggtgactggtctcttggtatgacagcatctcattccttttggtgtcaccaactctctaatacactgccctatttctctgcaataagaactgtattcatctttcctttgtggagatagatattgctatttgtcttataggagggagaggagagagatactcaggggctgacctgtctgggttctccctttgtggggctccaactaatcatcctgccaatggcttttgggtacccctcctgctcctggatttcattccttccaggcatggagcatttatcttgttggtctcacctcctgggttagaacttttctgaaggaatcatgggctgtgacctctttcttttctgctcatatttttcaaagactaattattatttctgtcgttttcaccatagatatttttatttatttaaaaaataaattttccttaatttttatgaatttagtgtaagaggagggattatattaaatgctcaccattttaaaattagaagtctgtcttctatctttccttcactaatatgtgtgttttgtacttagtcatatggtcaaatacttgtacataaaattatctgaaaaagcaaatgaaaaattaactagatttccccgtcgtatttgcatgtattccttacaaacttacctcagtcttcattttttcctgctctgtccattttcatccaaaacatacacatatacatcatacagtcaagataagcatgcatatatcacaggtatctttaacacagtttgaagatgtaacccttcattaaatgatgatggagaaaaaataaaggtaaacttagagggtatagttgagagacagtattaaaacaattgacttttaaccttattggtcttgattatggaacggagatgggtgaatcgttcatttagatttttttttttttttttgagacagagtttcactcttgttgcccaggctggagtgcaatggcacaatctcagctcactgcaacctccgcctccctggttcaagtgattatcttacctcagcctcctgagtagctgggattacaggcatgcaccaccacgcccaactaatttttgtatttttagtagggacggggtttcaccatgttggccaggatggtctcaatctcttgacctcgtgatccacctgccttggcctcccaaagttctgggattacaggtgtgagtcactgcacctggcctcatttagagtttatgttatttatttatagcttgataatattttatcttttaatttttattattgtctaaatattcagatttagaggaaatattattttcttcaggcaaaataacagtcctgagaggcaaagtttttttgcttcttttttttgagatgcagtttcactcttgtcatccaggctggagtgcaacggtgcgatctcggctcactgcaacctttacctcctggattcaagcgattctcctacctaggctcccaagtagctgggactacaggcacacaccaccatgcctggctaatgtttttttttttttttttttttttagtagagatggggttcgagaccatgttggccaggctggtctcgaactcctgacctcaggtgatccacccgcctcagcctcccaaagtgctgggattacaggcatgagccgccacacccagcctgcttttaaaaatattatttttaagttattagtagaatggacttattgaaatatgtactttttaactgaaggtacttggcatagtaagtttaactatgtttaactctgttgatttgcttttacattttgtgcaatcataagtgtccttcagttcttaaatatccacagcaaatcaaatattaactctgtgcatgtttttgagtttttattaagtagtgtttatatcattgtacctattcttatagctattgcctacatccaagtaggcattttgtttagttctttttctttagtctctcgaaataatgaaaagtgaaaatttctataatttgattgactgttttaagtctttaagtatattacactttgggcaaaatgcctactactgataaagacagcaaagtttttacagatgtataattaaaaactgacaatgcagtataatggagaacacacagaaagttccctttgtagtagtaaaaatgttggtatgcatagaggtgggaacttcaatgtgctagtgtggagggagtggtgtggaagtggtatgccataagtgtggaaaggtaggtaggaaccggatctttcctggccttataggttataataaggatattagatctttttctcaagccaataaggaattttaaaataactttaaagaggggaatggcatgattagtctatagttttaaaaagtcactctgccttcattatgggaaatacattgggggcagagggtatacaaatgcacatagggaggaggatgtgcattgaaacatatacatttgtgggcacaaaataaatattttgggatattggcagattggctaactctattctcttcagacttcttttcaatattttctgaaacgtcaccatggacaaataataattaataattaataattcattaattaatcattaatacaggaggttccaagatggccgaataggaacagctccagactgcagctcccagaagatgggttatttctgcattttcaactgaggtaccaggttcatctcaatggggcttgtcagacagcgggtgcagcccagggtgcagggcggggcatcgcctcacccaggaagcgcaaggggtcagggaattccccttcctagcaaagagaagccatgacagacagtacctggaaaatcaggacactcccaccctaatactgtgcttttccaatggccttggcaaacagcacaccaggagattatatcctgcacctggcttggagggtcccttgctcactgctagcacagcagtctgagatcaaactgcaaggcggcagcaaggctgggggaggggcgtccgccattgctgaagcttgagtaggtaaacaaagcggccgggaagctcgaactgggtggagcctaccacagctcaaggaggcctgcctgcctctgtatactctacctctgcgggcagggcatagctgaacaaaaggcagcagaaacttctgcagacttaaatgtccctatctgacagttttgaagagagtagtgcttctcccagcatggagtttgagatctgagaatggacagactgcctcctcaaatgggtccccgacctccaagtagcctaactgggagactcctcccagtatgggctgactgacacctcatacagccaggtatccctctgagatgaagcttccagaggaaggatcaggcagcaacatttgccattctgcaatatttgctgttctgcagcctctgctgggatacccaggcaaacagggtctggaatggacctccagcaaattccaacagacctgcagctgagggtcctgactgttagaaggaaaactaacaaacagaaaggacatccacaccaaaaccccatctgtaggtcaccatgatcaaagaccaaaggtagataaagccacaaagatggggagaaaccagagcagaaaagctgaaaattctaaaaatcagagcacctcttctccaaaggaatgcagctcctcaccagcaatagaataaaactggatggagaatgactttgacgagttgaaagaagacggcttcagacgattggtaataacaaacttctccaagctacaggaggatgttcaaacccattgcaaagaagctaaaaaccttgaaaaaagactagacaaatggctaactagaataaacagtgtagagaagtccttaaaggacctgatggagctgaaaaccatggcacgagaagtatgtgacgcatgcacaagcttcagtagccgattcgatcaactggaagaaggggtatcagtgattgaagatcaaatgaatgaaatgcagtgagaagagaagtttagagaaaaaagagtaaaaagaaatgaacaaagcctccaagaaatatgggattatgtgaaaagaccaaatctacgtctgaatggtgtacctgaaagtgacggggagaatggaaccaagttggaaaacactctgcaggacattatccaggagaatttccccaacctagcaaggcaagccaacattcaaattcaggaaatacagagaatgtcacagagatactcctcaagaagagcaactccaagacacataattgtcagattcaccaaaatagaaatgaaggaaaaaatgttaagggcaggcagagagaaagattgggttacccacaaagggaagcccatcagactaacagcggatctctcagcagaatctctataagccagaagagagtgggggccaatattcaacattcttaaagaaaagaattttcagcctagaatttcatatccagccaaactaagcttcgtaagtggaatggcacaatctcatgcgccaaacaaatgctgacagattttgtcaccaccaggcctgccttgcaagagctcctgcaggaagcactaaacatggaaaggaacaactggtaccagtcactgcaaaaacatgccaaattgtaaagaccattgaggctaggaagaaactgcatcaactaacaagcaaaataaccagctaacatcatgacaggatccaattcacacataacaatattaaccttaaatgtaaatgggctaaatgctccaatgaaaagacacagactggcaaattggataaagagtcaagacccaacagtgtgctgtatttaggagacccgtctcacatgcagagacacacataggctcaaaataaagggatggacaaagatctaccaagcaaatagaaaacaggggttgcaaaaaagcaggggttgcaatcctagtctctgataaaactgactttaaaccaacaaagatcaaaagagacaaagaaggccattacgtattggtaaagggatcaattcaacaagaagagctaactatcctaaatatatatgcacccaatataggagcacccagattcacaaagcaagtccttagagaactacaaagagacttagactcccacacaataataaagggagactttaacactccactgtcaacattagacagatcgagacagaaagttaacaaggatatccaggaattgaactcagctctgcaccaagcagacctaatagacatctacagaattctccacctcaaatcaacagaatatacattcttctcagcaccacatcccacttattccaaaactgatcacatagttggaagtaaagcactccttagcaaatgtaaaagaacagaaattataacaaactgtctctcagaccacagttcaatcaaactagaactcaggattaacaaactcactcaaaaccgctcaactgcacggaaactgaacaacctgctcctgaatgactactgggtacataacaaaatgaaggcagaaataaagatgttctttgaaaccagtgagaacaaagacacaacataccagaatctctgggacacatttaaagcagtgtgtagagggaaatttatagcactaaatgcccataagagaaagcaggaaagatccaaaattgacaccctaacatcacagttaaaagaactagaaaagcaagagcaaacatattcaaaagttagcagaaggcaagaaataactaagatcagagcagaactgaaggagctagagacacaaaaaaacccttcaaaaaatcaatgaatccaggagctggttttttgagaagatcaacaaaattgatagactgctagtaagattaataaagaagaaaggggagaagaatcaaatagatgcaataaaaaatgagaaagaggatatcaccaccaatcccacagaaatacaaactaccatcagagaatactataaacacctctatgcaaataaactagaaaatctggaagaaatgtataagttcctggacacatacgccctcccaagactaaaccagtaacaagttgaatccctgaatacaccaataaaaggctctgaaattgaggcaataattaatagcttaccaaccaagaaaaatccaggaccacatggattcacagccaaattctaccagaggtacaaagaggagatggtactattccttctgaaactttcccaatcaatagaaaaagagggaatcctccctaattcattttatgaggccaacatcatcctgataccaaagcctggcagagacacaacaaaaaaagagaattttagaccaatatccctgatgaacatcgatgcaaaaatcctcaataaaatactggcaaacccaatccagcagcacatcaaaaagcttatccaccatgatcaagtgggcttcatccctgggatgcaaggctggttcaacataagcaaatcaataaatgtaatccatcatattaacagaaccaaagacaacaaccacatgattatctcaatagatgcagaaaaggcctttgacaaaattcaacagcccttcatgctaaaaactctcaataaactaggtattgatgacaagtatctcaaaataataagagctatttatgacaaatccacagccactatcatactgaatgggcaaaaactggaagcattccctttgaaaatcagcacaagacagggatgcctccctcaccactcctattaaacatatcattggaagttctggccagggcaatcaggcaagagaaagaaataaagagtattcaattagacaaagaggaagtcaaattgtccctgtttgcagatgacatgatcatatatttagaaaaccccatcatctcagcccaaaatctctttaagcgataagcaacttcagcaaattctcgggttacaaattcaatgtgcaaaaatcacaaggattcctatacaccaataatagacaaacagagaggcaagtcatgagtgaactcccattcacaattgcttcaaagacaataaaataccaaggaatccaacttacaagggatgtgaaggacctcttcaaggagaactacaaaccactgttcaacgaaataaaagaggacacaaacaaatggaagaaaattccatgctcatggataggaagaatcaatattttgaaaatggccatactgcccaaggtaatttatagattcaatgccatccccatcaagctaccaatgactttcttcacagaattggaaaaacctactttaaagttcatgtggaaccaaaaaagagcccacattgccaagtcagtcctaagccaaaagaacaaagctggaggcatcatactacctgacttcaaactatactacaaggctacagtaaccaaaacagcatggtactggtaccaaaacagagatatagaccaatggaacagaatagagcccccggaaataataccacacatctagaaccatctgatctttgacaaacctgacaaaaacaagaaatggggaaaggattccctatttaataaatggtgctgggaaaactggctagccatatgtagaaagctgaaactggatcccttccttatactttatacaaaaattaattcaagatggattaaagacttaaatgttagacctaaaaccataaaaaccctagaagaaaacctaggcaataccattcagggcataggcatgggcaatgacttcatgattaaagcaccaaaagcaagggcaacaaaagccaaaattgacaaatgggatctaattaaactaaagggcttctgcacagcaaaagaaactaccatcagagtgaacaggcaacctacagaatgggaggaaatttttgcaatctacccatctgacaaagggctaatatccagaatctacaaagaacttaaacaaatttacaagaaaaaaaacaaacaactccatcaaaaaatgggcaaaggatatgaacagacaattctcaaaagaagacatttatgcagccaacagacacatgaaaaagtgctcatcgtcactggccatcagagaaatggaaatcaaaaccacaatgagataccatctcacaccagttagaacagcgatcattaaaaagtcaagaaacaacaggtgctggagaggatgtggagaaataggaatgcttttacactattggtgggagtgtaaactagttcagtcattgtggaagacagtgtggtgattcctcagggatctagaactagaaataccatttgatccagccatcccattactgggcatatacgtaaaggaatataaatcatgctgctataaggacacatgcacaagtttgtttattatggcactattcacaatagcaaagacttggaaccaacccaaatgtccatcaatgatagactggattaagaaaatgtggcacatatacaccatggaatactatgcagccataaataaggatgagttcatgtcctttgtaggtacatggatgaagctggaaaccatcattctgagcaaactatcgcaaggagagaaaaccaaacaccgcatgttctcactcataggtgggaattgaacaatgagaacagctggacacagggcggggagcatcacacattggggcctgtcatggggttggggaagcagggagggatagcattaggagagatacctaatgtaaacgatgaattaacaggtgcagcacaccaacatggcacttgtatacatatgtaacaacctgcccgttgtgcaaatgtaccctagaagttaaagtataaaaaaaaaaaaaagaacaagaactccaataacaggccttgaaaaactaagcgtgaaatccaggttgtggaacgtttgaccccaggaagaatgtatttcatctgtgtgtagttcatctgtattcttgtggtaatcaagcagacaccagctagaccactagttggcccactgctcaagacagtcgtcaagaccagacatactaccgcacacgtagtcaactcctgtgcttcccataaaaaccgtctagctagcctgagaaacttgagatgatctttgtgacatgagtccaccatctcctctggttgtcaactcctgaataaacccatttttctccctcaaaaaacattaataattattaataataaattaacaataaatcattaacaataattaataattaataataattaataataaaaattaataaaaataaaataaaataaaagtattaaaaactctaataaaatataatacaatataatatataatacaatacaacataatatgtgttatggctaaggaaatttcagattaggaaggacacctaatttagactaaaagagaacagcttcctagagaaggtgaaagatgagttaagtgctgatagctggatagttcagtcagaccaagaaagaatggcttttctgaatcaaagaagaacatttatgtggatatcctgataaaacggaaaacagatcagagtacaaagtataccattaccagggatgtggctgaagagataggccgacaagatattagatattatgctaaaaatccaggatttatcctgaaatggtgaatggtaattgaaagatttttagcaagacagtgacatgatgaaactggtatttcaaaatgaacatgctagcaagaggtgggataatgtactggatgagaataagacgggaagcagagaggcccattaggaatttgattcatttattcactaatggtgataccaaatgcttagtatgtaacaactattgagccaggtgttagggacacagtggtcaacaaaaaagagggccactgctttccttcaaaggtttaaaatctagcacatcaataaaataatacagggaggtaatccagcgcttgaccattctctccctttaaaaattatgtgtgttactttattataatttaaaaatacagatgaataagaagaatgtgaacaaaatcagacatccactcaacctctatggaatgttaacattttattgtgtgtacatacttctagatgtttaaaaatatagtatgtgtatatattgtatatcatacaattatatgaataaatcagactgttctcaattggtttatgatctagtttcctcttaacaacacatggtgatctttccataaccataaatctatttatccatattattttttatgaggggatgatgttctactgcattttcggacattttaggtaggactattcaaaacaatgttagaatgaatattcttataggcaagttttaaatttcatttcattagattaaattcttagaagtggaataaaagaaaatgcacattttaaaggcctttgataatgccccaaaccctcctttataatcttttcttctggcttccataccatactttgttaggttttttttttttttttaactacatcagcaactcatacacagtcttcttcattagttcattgctgcacattgaaatcatctggggatttttaaaaattactgatgcctggctcccacccttagacataccaatttcattggtatgtggtacaatctgggaattggaatttttagaagtgcctcaagtgattcttacttgcagcaaaagatagaaaccactgtattcttttattttccctgtttactacagaaatttaagttccatcctagatctgcatcttaccttttttcacatgctcttcatatgtaatcataatttcacctcttccactctaaactctatgaatataattaaaaactcgtatcttgcacttttcctgaggtccagttccactttgttcattgcctataggaaagtgtgcactaatgctaaatatagaattagctctcaaacttggtgtatctcaaactgaattaagaggtctcccttactcttgataaacagaaaactaaacacatgtttaaaaaaacagcaacacctgtggggaaagatattttctacctttcagttggttgcaaagctcttgtcttgattctttctctaaaacatattttaaatcagtttcccctaccctttctattaccattaccacaacctctaccctcagagtagtaccactgtgacaatacttatctgaatatctgtcttgggagcactggcctgtcagagtagtttgcctgcaatctcacttgcatgaagatagcacctagtgaataccagtagatatgacattagggactgaaatcaaggtggaattaaaaatttcaacacatgtaagtaagagtgtgtgtgtgtgggaggaagtgggataatgtaggagaagggacagtgatcatttccaactacttgaagatggccactcttgggccaggaactcagcccagggttggagaatgttgagatacatcgggctcatcccgattgatttcaggctgcaaaggtcactttgagaattaattgacccaataatggaggaacaactataacgttccaggagaaagaaggctaaaaagcaaaactattttatttgtgttataaatatctgaatttttaaaaaatttgaactccttacccaggcaagtctgccataatttcaaccaaggaatactgacaaatctagaaattgagagatttataagctactgaatctaaaatatggaagcagctaagctgacatgactggggaaagtgaggatcctttaatctctgactgtgagggtgactgtccttgacatgctgtgaagagtagctataaaccatcacttcttgtttctcagatctcaaactattgatccactcagctaaaataaaagctccattgagcagaggccttgattgtacaattaattattctccagcagctctgagagtgtgagatatatggtagccatacaaaaaatattgagttaataatttctcatactggggccaaaacccctgtgaccatagtagcaatgtagtagggtgttcaagtgtgttacttctttagaattttagaaatgtaatttaagaattttttttttttttttttttgagactgaatctcactttgtttcccaggctggagtgcggtggctcgattctggctcactgcaacctccgtctcctgggttcaagtgatttgcctgcctcagcctcccgagtagttgggattacaggcgtgcgccaccatgcccagctaattttgtatatttagtagagatggggtttcacatgttagccaggctgatctctaactgctgacctctggtgatctgcccgcctcagtctcccaaagtgctgggattaacaggcgtgagccaccactcctggcctaagatcattttaataagatttaagagacactaatttctgtctttcaagagaggtactaatttccatctaagcaggcccaccagaaagtagatatggaaaaacaggacaagcatataatatttgtaaagcaaagcattttatttctagaggaagatttgaaatccatggaagttaggagataacacagttgttttagttatttgtcacactttaaagtcattgtagcagttaggaaatagtgagatcttggcaaacaaaatgtggacatctaggagaagccaaagagttggcaacactttttaagcatctctggcagctcctgtctagttggactaaaggaataccatatcctattataaatcacatttccctggaactcagcttaaagggcaaactttagaaggaaaacctccatcatcctcattcaatacttcagctactgtttcttatccgcatctaaacaaaggccattaaatagagtttcagggaaaggcagagctgccaggaatgatgcagagatggcctttttctttagtaaaccagaagcttaaatgggcatgactccataagattttttgttttagtaattagcaaatagagtttcaaattcaaattgacttgaagcaagcagaagttttaaattaattaaattttccaggaaagggaagcctagccctaggaacagagattactcaacttgtaatgcattcctcaggcctaagtatccacacctataaagaatgacttggacttgcaaaggtaatagagctacttaagaagaatctctccaacatccctctgagaagcagcccagaaagatacaaggcaagggaaatctttccagggagaagaactcaaggtgctgaatggcttttaaaggacatttctgagccgggtgtgttggctcatgcctgtaatcctagcactttgagaggtcaaagcgggtggatagcttgagtccagtggtttgagaccagactggtgagcatggggaaatcccacctctacaaaaaatacaaaaattagctgggtgtagtggcacacacctgtagtcctagctacttgggggctgaggctggaggatcgcttgattctaggaggttgagggtgcagtgacctgaggttgtgccactgcacttcagccttggcagtagagtgagaccttgtctcaacaaaacaaaacaaaacaaaacaaacaaaacaaaacaaaacaaaacagcaaagacactttctctatttccaagggagcaagtcaagaacattttatactgcctgctcctaacaagtgattattctcaagcccctttctttcccctaaatgagataattttattaaggtaattctgtctgtggtgcacctttatttgcccctctgaatccttctccacgctccaccttcctctacctgcaatgctatcctgggaggctgacctgcatgaaaaaccttaaaggattcttacctcctctggcttccagttgggttcagccaatggcacagcagtagataagaaggaggtggggcgggcgcggtggctcaagcctgtaatcccagcactttgggaggccaaggcgggcggatcacgaggtcaggagatcgagaccatcctggctaacatggtgaaaccccgtctctactaaaaatacaaaaaaaaaattagccgggcgtggtggcgggcgcctgtagtcccagctactagggaggctgaggcactagaatggagtgaacccgggaggcagagcttgcagtgagccgagatcgcgccactgcactccagcctgggcgacagagcgagactctatctccaaaaaaaaaaaaaaaaaaaaaaaaagaaggaggtgggaggctaggagctaggataagggtacttatcttaagcctccgttcctgtgtccctcagctgaaggtcactgctcatttcaggccaaatggcttcatgggactctccctcctttagtaaccgctggccgaggggcaatagctcagctactacaaaaccccgagctcttgaattataaatcagaattaccctacgtccacacttaatttccttcttgaaatctactctctacatagacaagtgaattttcccctccctgaccaaatcaggcctccaaatataagcttttgtagcttgcttaaattcttgattaatttttactattaaatgattagtttgaattctcccttcctctcacagaatgtaagtttcacgagagcagaaagtgcattagtgttgttctcagctgtttgctcaaggtttaaataaaaacttaaacatagaaacaaaaatttttctttttagttgtgctttctattttttcttgggaccctgatagacagaacagtgaaattcatcatctaactgaagattgcagtattttggaacttggcattaaaagcctgactcaattacactgaaggagattgtacatctcacagaaagcttggacttgagcactgacctccagacactacctgagaaggtctagtagacatgattttccattggagaggtggtggtgtttttgatggcatgtagattgtgactggcaggggcatttttggaatgtaagcatgtctttgagtatgtgctaggtaaaattgaagagtagattgtagtgagcctccactgtggttctgctttatgccaataatttttcttttaattttctattcataaaataatctgcattaggacttttgccaattcagcagaattatgtcattaatacaaaggattataatagaacataaattggctggcccatgcatgaaatccaaaataatatgagtattcacaattttgacaaagcattcaccttaagaagaggcaaacaagcagggaactaatacagatacagttaggtttggtagaacactgatacttgtgatatttatgacataatcatggttctttttgtcataatatggtattttatatagctatttacttaagtgactatatgcatatgaactactaacatttttcacattttctctgcccatatttgggctgctcaataacagatagaaatgttatagttaaaaagaaaattattggccaggtgcggtggctcatgcctgtaatcccagcactttgggaggccgaggcgggcggatcacgaggtcaggagattgagaccatcctggctaacactgtgaagccccgtcttactaaaaatccaaaaaattagccaggcgtggaaggacatgcctgtaatcccagctacttgggaagctgaggcaggagaatcgcttgaacctgggaggcggaggttgcagtgagccaagatcgcaccactgcactccagcctggatgacagagtgagactccgtctcaaattaaaaaaaaaaagaaaaaagaaaattattatctggctgggtgtagtggctcaacctgtaatcccagaactttgggggctgaaggggtggatcacctgaggtcgggagtttgagacaagcctgaccaacatggtgaaaccccgtctctactaaaaatacaaaaaaattactgggcgtggtggcaggtgcctgtaatcccatctattcgggcagctgaggcaggagaatcacttgaacctgggaggcaggggttaccataagctgagattgcgccattgcactccagcctgggtgacaagagcgaaactccatctcaacaacaacaaaaaaaaaaaaaaaaagaaagaagaaaaaaagaaaattgttacctattctccttagataaccctaatcttaatctagtaatactgtatcctttttgagaagatttcagctgtatcctttttgagaagattcagctaaaggttaattcagctaaaggttaacttcagctaaaggttaattggttaacgtgacatattacgcttaaaaatccctaaatgagtcgttttaaaaacctgtctttccctctaatagccagagtttctttgtgctattgtgttactttctgattcatccgagtgatgcttgagaatgccaggaaaacaataaaaacatttcttgccactgagccctacctttgcctggaactcagtgaacatcctccatgaggtggcaaaattgttctggtattagtttgtagtaaaatttcctgaattaggagtggaaaggaagacaatattatgtaaaactttccgtgggttcacaaaaatgaagtgttatcttgtgttcagatcccagacttagagaaaatgattgtgttttctttttcttttcttttttttttttttgagacagagttttgttcttgttgcccaggctggagtgcaatggcgcaatctcggctcaccgcaacttccgcctcccaggtttaagcgattctcctgcctcagccccctgagtagctgggattacaggtgtgagccaccatgcccggttaattttgtatttttagtagagacggggtttctctacgttggtcaggctggtctcgaactcccaacctcgggtgatccgcccgcctcggcctcccaaagtgctgggattacaggcataagccaccatgccctgccaataaaatgattttgaacatatagttctatattatttatagtgaacatttaatggaggggaagttctgccttcaggaagactatgaatattgggactgtgtccttagtagacttggcactaaaaaaaatcactcatttgacatcacaagattgcacaataaatattggagatgttggaaaggtacaggtacacaatggaatactacacattcgaaatgaagctgtagaattgaatttattgacaaagatgtttataatatatcatcattaagtgcacaaaaagggtaaactatatgctgaaggatagtttgggcagcaagcaaaagaacatctaattcaaaatgaattaaataaatatatttatttttataattatcataattacatttattaatctaattgttctagtgcagaggtaaaataggcttcagggtagactgattcagtgacccaacaatattattaaaaaacaatgttctttctgtctctctgctctgtaatccaaaatatctgctttatctcacagctagttcccccaaataattgtaagatagattccaggtgcaattggatattactacttgctttctcattcatatgctgaagaaagagagaatggcttgttattgctttctgcaaagaccaaagaggaaatttttgaagtctgtagccactatctcttcatttatcattggctagaactgctgatttctaaactgatagctggcggaaagaatgtgattatctttagaccagtcagactcacacattgagttaaaggcaatttctaaaatcagagtactgccatttcatggatagtagaatggaatgcatttggggatttggacacagttaaaaaaatctctatctaatctctctctatggatattctagaaaattaatattgtcatatgatagtatctggacaatgacttacatttctttttaattttcttcctttcactcacatgtatataatattcttctgtaaataagcatacattgttttttgtctctttaacattttatatggaaaatttcaaataaatccaaaaataaagatagtaataaaatgaaacctcaagtatccatcacccagattcaacaattatcaacttctggaaaaccttgttttatgcactgtttgtaataagaaaaaaaaaagttgattttagttaaaaaagaagttaagatctgcttaacattttctcttgtccatagaatataccttaaagcaaatcagtaaagtttagctaaggatagcccaatatttttcctgtcaattgcccaagatctctcttaaattataccccaagtatttttttgaaaatttggtttttctcagtttcttatcctacatatgcatctcaaaaatttggaccgcagtaccccaacatcaggagaaaagcacaaaactctaggagcttgtgtatatgaaacaaagtggctcactaaaagcatagttattttgaaatctcatttttagttttaaagtctgtatttttttttttttactctatctaccaatgtttaatagaaataaaatatttcaaattactcaccattgaataaacttgacactgttggaagatggtccatgttggtcttttggcttcttgtcctctgaggcaccctgacaaatacccctgtgaacacaaggtccccaatttaagagtcatagattatagttttcttcccttttaagactccccttttgatcgttgaccatatttccttgacttttaaacttcattctctttgaggactttgctttgaattcagtcctcttgttttttccattttagacctcctcagctcgtatgccctatcttaggattaatactcactttccagtcctggccaggcctggcccagtactctgcaagaggatcttggacctgtaagtcacaaatatcaaggtactcattcatttactaaatctttattgagtatcaaccatgtttctggcacttagctagtccttggggatactgtggttaaaaaggataaaatctcagtgtttaagaagactaaagacatcaggaacacaaaaaatatttaggcaattataaaatgggcaaataagtgctacattggatgaagtactgcatcctataaagcacaaagcagtatcctaagcagatgagggaagtcttccaggaatgagatgcagtataacaataggaaggaaaagtaagtggtggtaattttctatatttgaatgaaaacttactcttgctcaaccacgaaggatgttttcttagaaataaagggattgtcaaaagcagcattcagtatgggagcttacagtgatgtatctagaggggacaagcatgaagagtttgattactcgggagtgcagtttagaaaataactatgtttccttcacagaaaggaagtgttctgccaggcggagtcattgcttccttttctctcttcccttagtcctttgttttcttttttcttttgttttcttttctattttttctattttttttttttttttgagatggagtctcactctgtaactcaggctggagtgcaatggtgcaatctctgctcactgcaacctctgcctcccaggctattctcctgcctcagcctcctaagtagctgagattacaggcacatgccaccacaccaagctaatttttgtattattaatagagacaggggttttaccatgttggccaggctggtctcgaactcctgacctcaggtgattcgcctgcctgggcctcccaaagtgctgagattacaggtgtgagccaccacgcctgggccagccctttgctgtcatatcacatgtggaacatccctacctgcctctcctatgccttcctacctgaagaaataaattaatcattttcccttctaatctacaaactgtgtattatactgaaacacaatgatactttaaaaaatttaagaattaaattgattcaaattttattttatttttagattcaactgattattttgattacttaatcattaaaaaatgatactgttcagtattcagaaagtttgggttcatttttttctttcttgtttctcaataaaagaaatgggtagtggtagtgatgttggcatttgttctgaaagataaatgtgacatgatactcatttcctgcctggcgcggtggctcacgcctataattgcagcactttgggaggctgaggcaggtggatcgcttgagcccaggaattcgagatcagcctgggcaacatagcaagaccgcatccctaaaaaaggagtacaaaaaaaaattagccagtctcataacttggcctgaaaataaataaataaataaataaatagactcatttcccattgagtaatccagaaagagacacaccctgaatggtattgcctaggttttcttctagggtttttatggttttaggtctaacatttaagtctttaatccatcttgaattaatttttgtataaagtataaggaagggatccagtttcagctttctacatttggctagccagttttcccagcaccatttattaaatagggaatcctttccccatttcttgtttttgtcaggtttgtcaaagatcagatggttgtagatgtgtggtattatttctgagggctctgctctgttccactggttataggaattggcaaggacttcatgactaaaacaccaaaagcaatggcaacaaaagccaaaattgacaaatgggatctaattaaactgaagggcttctgcacagcaaaagaaactaccatcagagtgaacaggcaacctacagaatgggaggaaatttttgcaatctacccatctgacaaagggctaatatccagaatctacaaagaacttaaacaaatttacaagaaaaaaatcaaacaactccatcaaaaaatgggcaaaggatatgaacagacaattctcaaaagaacacatttatgcagccaacagacacatgaaaaagtgctcatcatcactggccatcagagaaatgcaaatcaaaaccacaatgcgataccatctcacaccagttagaatggcaatcattaaaaagtcaggaaacaacaggtgctggagaggatgtggagaaataggaatgcttttacactattggtgggagtgtaaactagttcagtcattgtggaagacagtgtggtgattcctcagggatctagaactagaaataccatttgacccagccatcccattactgggcatatacgtaaaggagtataaatcatgctgctataaggacacatgcacatgtatgtttattgtggcactattcacaatagcaaagacttggaaccaacccaaatgtccatcagtgatagactggattaagaaaatgtggcacatatacaccatggaatactatgcagccataaaaaaggatgagtttatgtcctttgtagggacatggatgaagctggaaaccatcattctgagcaaactatcacaaggacagaaaaccaaacaccgcatgttctcactcataggtgggaattgagtaatgagaacacatggacccagggtggggaacatcacacaccagggcctgtcatggggtagagggagggaggagggatagcattaggagatctacctaatgtaaatgacgagttaatgggtgcagcacaccaacatggcacgtgtacacatatgtaacaaacctgcatgttgtgtgcatgtaccctagtacttaaagtataataaaaaaataaaaataaataaaaaaaagaaagagacacacccaaccattattgaagtcctctaaggtggggatagaggacacacagttcatcagggctgaggaatagagaatgggaaaacagatgaagaaaggcctgtgctgaccttttccatgccctcccatggatgtgtttttcctgcacgtcaagttatttaagcaaaggattgtttttgtctggatttttttcttttccaacttcagccatttcttttgttctttttaggcatgaaacattaaataaagttattcttaatatgggatattctcccctaagtctttttagatgataaggaaacagcatgtccattccaatagcctgttcaagagttctacttttaataatttgtgtctcatacttccagatagtccacacatagggcaggtcttattatttcttgtgtatttcattataaccttattaggcccaaacaaaataagagtcacgaataggcaggaaaacatatgactgtagtaagctaggtgttgaacaggaaactgtggcttccagagattaaaatagttttgtttgtgatcttagaggaaacccaaaaggtgttcacttaggtctggttttaaacaggcagaacaacttattttaaagtaatatttctggtaattctgcagctactttgtagtgcctctgctgttctaggcattgtgctagatggtatgaggaattaaagatgaataagaacaaagtttccttcttaggagggaatacaatctaagttagcttttctctttatttatttatttatttttctgagatggagtctcactctttcgcccaggccggactgcagtggcactatctcagctcactgcaagctccgcctcctgggttcatgccattctcctgcctcagcctccccagtagctgggactacaggtgcccgccactgcacccggctaatttttttgtatttttagtagagacggggtttcaccgtgttagccaggatggtctcgatctgctgacgtcgtgatccacccacctcggcctcccaaagcgctgggattacaggtgtgagccaccgcgcccagcctgcttttctttattgtaaccaaaatcatttgatgacttccaaacagggcaacatatgtgtcaaatatggtcatatttaaataactatgccaaggttctgcagttcaattaacttcatttaatttggacacttctagtattagaaaaatatctttttttgctatcatccattaaatcatcaatatttttaaagattcacttccatctctctttttaagaatgaggtgttacataaaactataggtaaatgaatttgaaaaagaaagcaagtaaggctgagtgcagtggcttaatgctgtaatcttagctctttgggaggccgaggcaggtggatcacttgaggtcaggagttcgagaccagcctggccaacatggtgaaaatccaactctactaaaaatacaaaaaattgggtgtgttggcatgcaccagtaatcccaattacttgggaggctgaggcaggagaattgcttgaactcaggaggtggaggttacagtaagctgagatcgtgccactgtactgcgccactgcactccagcctgggtgacagagcaagactctgcacccccacccccccaaaaaaagcaaacaagcaagtgcaagtaagactttgtatctctgattagatgttgaacagtgaatgtctcttcccagacaatttagataatttacatacattctttctctggttagccttacagattaaaaaatggtggctttttaagttttaagttgagtgacttatcaaaaatactttaagacttgaagaccaccagtctagaagttagagatgaaatattagaatatggcagtaaacagtccagcctatgaactagaactagattgactgggttcaaatctcagcttagccacctactagtatgagacttgggttaagttaaaaaagcccttgtatctcagttctcttatttttaaaatgctgataacaataatgtttgtaagatgttgtgggcattaaatcaataaatatatgtgaagtgcttgaaaaaaggtatggcataggcaaacactccatagagtgtcacctattatcatttttatgtgagtgtgggacctgctatccaatgacatcagtagtctcccactgtgacataaaaggattgcatacaaagaaatgcttaataaataattcattcgttcaaacaagtatttttgagagcctgaattctagattctggggatagagccaaggaggacaagctgaagttctcagttttaagggactttcatctgaatgaagtaaactgacaataaacaagaggaacaaatatacataaacatattaagcattactacctactttgaagaaaaagaaagcaggctaaagggatagagactaataaggaataataatgggcaagctgttatagatggggagatttacactcttttgaggagatgatatttgagcagagatatgaatgaaatgagagtgaatgctgggaaaatcaacaggaaatgaattctagaaagtgggaacagcagaataaaggccaggaggcagaactgaattcaggggttcaagagtaaacagaaggcccatcgtggcgtgaagtaagatctagtattcgaagatgaggtagaagtagtcaaataattttggatgaataatagatacatttaatgactcaatcaaaatgatgagacatcatgctgaaaggaagcttaagatacatttgtaaataagattataagatgttgagtgggactttttttgttgcccataattgaaaataagaagagctaagtaaccccctttctatgagaagctcttaatagatgccaaatattgaggccagacactgtccccacctactaaagggtatgttacgaggcgaaaaaaattctctcctaccagcaactagcacctagctctggatacgcataaagagaaaactggagagagaacagtgcaagtcagcagacagtgctcacagggaaaggttactcctcttctcaaggggaacagaaggattattatttttttcttgctgaagccaattaatgggagtccatcagagaatgtttagagattgtgtgcgagtttgtgggaaggaagactggcaattcatttctcagctggctggatggtaatttactaaacacaccagtccctctggagctactatggcggagcgggggcgaatgtctccgcggagttgtgtatttgctacctgaagtttaggactcacccctgaatccaaaacagctgctagtcttaacatttctgaaggagaggaaattgctggagtagcttatggtaacagagttagaaggaactgtggttcagagtttgttcttgagaggggttaaattccctcctttatccccatcctggtcttttgtggcccttggagcatttagaagatggtctcagaggttactatggctcaatgcaaaacagcatggtggtaaggaagggagcagaatagctggtagtgaggagacactccagctggggaagcagttaggggcatggtctgctgtcagggtccaggcttttctctgagggattcctcagtgagtgagggggcaaagcaaagacgaagagtgtctatagaaaaccaagcacaccaccagcacagatttctcaacaccaccatctgttagcaatagacaaaactggattgaaccagagaaaaacctaggacactttctcacgcagacatgtaactgattatgtaagatctctaccacctttgtcttctctctctgaccccaaaactagaggagttcagcagcggggagtgaggatggttgtctcagagtcagatctccttccaacttctctactccaagcagtcagcctcacagtttgtgttgagggcaaagaaaggtaatcatatttatgttagtttcacaatccaagttttaaactggacaaaaataaacttcaaataactgaaactggtagaaagttagaagatttgcactttgggaggccgaggagggctgatcacgaggtcaggagatcaagaccatactggctaacacggtgaaaccccgtctctactaaaaatacaaaaaattagccgggcgtggtggcgggcgcctgtagttccagctactcgggaggctgaggcaggagaatggcgtgaacccaggaggcggagcttgcagtgagcagagatcaagccattgcactccagcctgggcgacagagcgagactccatctcaaaaaaaaaaaaaaaggacagttagaagatttgctaggatattcattaaaggacacgagaataagacttgacaatcatgattggaagccttgattagaataaaaaatataactcttttgtatctatgctcttgttgagacacattacatgagtaaccaaacaatgaaacataacactataaaccacagcacatctatggagaaatcaaaatgcactaatcgaaaattataatttcgtgggacattttatttaaatgtaaaatttcatctggcttctcagttttgataaagtagagagtctgtcaattgcttctttcttataataaagtgagtcaatcttccttccatcagcaacatataatacaaattcttcaggcccttgtcaggaatataaactcatactttctcctattccgtttctaaaaaggtcttctaaggaagtaatatttaagaaagttcatctaagaaacattgtaccctttgtctaagtactttgaattctgcctttgaatcaagctagaccactggaagtatatgcacctgaccacaaaaatatatctcctttaaaaatctgtcaccaactttaacttcaaaattttattctcaggcttctttgaattatcataagaaagtttataaaattctcttctatttgttggtaaaaatattgctgatattattcaacgcgttgctcagtgtcatctccatatgagaaatttctccatcaacttagtggcaggaaaaattctctcttgatttgtttctttcttttaaataatgagaattgtgaaactccctaagtttcccttgttattcttgctatcggcaagttcaaagccaaatttgcagctctgtcagagcaagtctcttatacaatatgtacaatgtattccacttcggttttttcttgaatttgaaccttattttatcagtatattttatattttaggggcgttgtctatttgtaaagaaatggagtataggtaaataaatttggttcatgtgctaggaaaagttggttcagatgactgaaagttgatctcctaacatgaaattgattaatctttgaggtgtttttcaaagactacttgcaaaaaaaaagaaaaaaaaaaagagacttaaaatggcccccaaaatgttatcttcattcattagtttaatatcattaaccaggctaaactgtatattccaataaattgaacaataataggattattttaacattattactgtcagttaattctaaaaaccttatctttggtttttattatatgtaccattatatattgaaaagcttagcagatcctcacatcaatgtccagaaaaattatctccagcattatgaagacacttatatcagttgtagaacatcttatagaagaatagggaagagaggtaatattttgggtaagaatgtagcacaagcaaaaggagagtcagtgacagagtagtgacagcttgtctctaaatgctaattaattatattgatcctctttgttttctcagcttaaacaaaataaagtgcatgggtaccttcaaaacaacacatgatagaagggaatggattcacaaatgacaatagctgtgtttacctggacacctagttaattcactagtttaacaatattggccagtctgtaatgtacatcccaataaactgaccaataaaaggattgccttagcattatggaaatatagctaaagtataagtttaagggcttccataaattaatcagattattattatacataggcatttatgtattatcaggtataaaagacatttgttcaagctaggagatattcaaataatgataaaaatcatctatgactagccacctgggaactatacttttctagtttaaagccataagatgcctcattgctttgacattgctaagtataaaaaggactgtagaataatttgttggtgataaaaatgtctgtggtcacattgctattttacttattatgcaatgtaagatatctactgtggatttctaacagactcaagtccacaaatatatttctcctgactgttcctgacattgcacagaatggcacagggaacacagaccaacacacaaaaagaagagtaactctttgaaaacattttcttcacactgtagtttaggacaaaagtattgcagaataaaatttatggttttagaaaaaacagcaacaaaaatttgaatgaaagacaaacttttgctttttcgaacttttggaagacaaaattatgactctaatgtttcattccttcttctttccttgccattcaaatttctactaaagtgtaagatatatcataaaatttgataatatacactgcaatgcccattgagcagactgaacaaaggccattaatatagcaaggaagacatatttttaatatctttagtctgacattcacttgtcctttatttacatatgcgtaatctcttaattttctacaaattgtagcttatactcacagagttttaaaaaaattcatgatagccctctcattttctgtatctacaattctaggttatatattaccctaagtatacaggtccataggcctatataaagaatttatttgaatttgaaatcttgattttgtgaaagaaacaaatgtcttgagattttgttaaaataagtctggcaagtcttggcccaaagttacactgagagggaatctgttttcctttgaaaacaaaagtattatcaatattttcataaaatgtgagtataaaatagaacatagtattattaaaccatattaacatttcattggcagagatttcactttgttaaaggctgtataagaacagcttaatctcataacccagaagtttttactgttattattgcctctttatttttggctaaagtgtaatttttaaatgagtatacagaaacctaatactatatattgaatgactttaagtaaataaatatccatgctattcatcaggataagtgacctagtgaccagaataaaaaggatatatgttggtagcccctagcacagtatgcctcagcacagaggtttcttgggttactgctagtgaatgattccaattcttggccgtctgatcccacacattacataaattccaactcctgcatctgtttaggtgagctgttggctaaatggatatgtaatgaaattaaacaatatttttaaggtgctttttaggatgggttataccccctctttttctcctcctttccttgcaacctgccctctactcattctttttatgcatatttttgagagcctgaatatgctaggaagagggtttcagtctgttaagaattcacaaccttgtggagttgagatacaattaataaaatttctagtataatgaggtaagtattatgataccatgaaagcacagaggagaaacacctactctgttttgtaaggattagggaaagcaatttagagattatacctaacacaaacacacagatatttgcatagtatgtgagcacacgtttaaaaaaatgtaattttcaccctagaaataagacagtagtgattcagcgtgagttgatatgcctgtctccactataatgaaagaaatataacgtcttaagtatgggttgacatttgcaaactaactgatttttctagaagaatgatgccacataatttaaaaatattaatgcttttctaatctctagtgtattttcaatggctaacatagttaaaaccaaagtgaaatttttattatgtacataatcgaatgcaaattgtgtcaggctagtttaaaaaatatgaatgtcagtcctggcttggcaatttaataactatttggtttttgaccaagtcatttaacttaattaaacctcagtttcttctctgtaaacaagagaaggtcaagcaagatagttttaaaatttctttccaaatttatacgtctgacttttctaaaaaatctggtttacactaatacttaaaagaaattatcttaaaacaataaattataaatttattttttgctcttgctccctgtaaaatttgtccttgtcctgctagtcacatatagtccccactacaccagccaagacttgtcagactggttctgttgagatcatcagtgacttatttcctcacttcaattcagcccacaaagtcattgatagagctggattcacacacttggatgtagacctcgaccttcacaggactcttcattgctggttggcaatgatgtatcggtgagttagttccctttttctttctagaagtcttaaggtaacttttagtttaaaacagtatgagccacaccaaggaatgtgtagatctacagtttattatttttttaaatatagaaacatatttttgagattttacataaaattatgtcaagaaaaagatttctattctttctgtattagtgtttcctgtcctcttttgttgtatcccatgtgtttttctgtttacttttagaaggtttctacacaatgtaaaggtacatggtgtttgacagctgtcttttagttagtttggccatatgtttcaagaaagatataacatatttttagcttgggctttgtttgtcttattgagaaacacttttattttagaaggtgtacatgaaaaaaagtctgaaataatgcagaaaaaaatgtttatttctgtaagtagttaaaaatttaaaaactctagatgttttgaaagaatcagaaacaactgaagaaaataatatgactaaattattatagcctgatttaaaaaataaatccactgatatgcctggccatagtcaacttctccaaagataagtcatgatcattttgaggttttctttcaaagttagaaactaatcagtaacaaggttttggggtactagttttgtctttgaaaataattttatctcctgattaaaatttattttctctgattctcatattggcatatcattttttattagtttttactttgagaacagtttgaaaatgttaaactttgaatgaaatctgtggtcttcatttaacatggaaaaacaggttctgtcatcagttgaaagttctacatacttgttattagaagtttaatactcttctgtacatatccatgaagcaactaaaagctacggatactaaacattttgttgggcttatcaaggctccctgccttttgcaagtatttctttacaaccaatgatggttttgtatcctattctctttttctcattgactttactatagaaaacagtgcttcaagaaagcttccaataaacttaacatactaaatagattacaagccttatctatggtatatgtcagagatttggaatttggttataaatgtgtagaggcggtataatgtgggaatactggagtgaatttttctgagtgtagtctctaatttgaagcaaaagatgtgactatttttaaaaatcctgctgcagaatagatgcaaataatctctcatggaaaaaaccaaaaaccaaaaccaaccatctaacaaacaaaaacgtcttcctgatctgaagattgtatgaaagatgaagcacatctatgtttgagtgggtctagatgagataaaatgttaagagcatgtactagagcaaaaaaggattaagtttattattcacatttgctgtcgtaaatgtgccaacaggagtgttatcgaggaagagggataattgaaatcctaggatataagtagacaatttcttcttaaggtcattggttttaactcagaaagaatacaagaaacaggtggggaattttattaaatagcatgctccttccttttcagtcagatttcggatagccttctccctgactctacctgaataagaatcagttttttttgtttttttttagaatttaagggtaggaaaaaatttaaactgggtaagcattattcttcttgtactgccattttctccaaactcttattttggactattctttgagcatgaagagatcaacacatgaattttataaacacacaacagaaagttaaagaaaactctatcaggcataagtttatagagaacagatttgggaagagaagaatgtgtccattaaatatatttattggtcataggggtgtatactaactgtatttatcagcaaccactgagaagaagtgaaaataagcagactgaatttataggcatcgacatccacacatattgagatggctgaaggtgaaatgagtaatattcaaatgagacaaaatggacaactttaatttttacctaatagggtaagcactgtctctaaaagtgtggtccgtagacccctgcattacagtgcttattaaaaataggaatctccagctctcatcccagaaattctaatgaatctctggttgagacatggaaatcatatttaaaacatttacacaatgtaattcttatttaccctaaagtttgacaagcactaatggtgtaaagacatagaaaaagaaaaagaaatgtgtaagcctgaaagaaattaaaccataaatgaaataggccagttgttaaaagtagttctgttttatttaaattggtgtaattacatcttaatgggaggtgctctttcccagtcacctttcccttcaagggagaagagtactcatttatgcaacatggtgatgattaagaaagagaggataatttcagaaaggaggggaaactgaggggggagaacatagacattttttgcttagtttgtgtctgataaggaagatgactttatatggatcataaaaatctatttgtttacaggaaaaaccttggtataaaattaatgtagcagtgttaccctgtgacattagtcagtatggatactgaagagacactccttttaggcttaggcccagagttgctatatggttgtgttataagtatttagcatgtgctcacacttctccttcaactagaatcagccctgatccatataacaacttttagtgagttctcattgcatactaagtcctgtgtggaagaaaactctctgttgagcacctactatatattgtgtattttataaaatgcaatttcattaaattttggtaatgttttgataagtggttattgctttcattccttttaaaagatgaagcacctgtggctcagattgtctaggcggttagtaagtgtcgaatctagaatctaattctgatctttctgattttaaaatatacttttttccctgtaacatattgtctaccatgtgtaggaagctataagtagaatctttgagaagtttacagagaaaatagatggcaacagagaaatagaaaataaacgcacacatatccacacatggagaaaatgttggtgcatagatttaaaaaaccagaagatgtaaagactaatatgaaatcatgcacatttatgctgaggaaagaagtgtggaggtgtaattttactttcatttataagttttaaaaacattttaaaaaatgcattgcctgcccttatacaaccgactttgtatttaaactaaataaacagtgatctatcttttctgcactgtttcaaaggtgatcagagtatagcactttaactacatcatctctgttttctaaaaaggattacatttgctatattgtgaaaatcatgtttatcttagagcaatatttcatggaactaattcactggtctgcagtagctgtctgctaaatgaatctttgttgttctgtcattgttgtctgctttcctccaaaaatatgtcattgcttcaacttaaagagaaaataaatagaaacaatccagagaaacatgaaaaatagcagtgtcgtgtgtttccgtattagcactgagatttataagcatgcctgatggttttagtgcttgtgaaagaggtagattgaacagtcgtgaagcaggtcttctggaagggtaggaggtaaaatgggttctctggcttgttttatggctctatcagggttagagtttagagaaactgcacagagaagttcttcaagtgcgctcctttggatctgctctcattgaagataatagctaagaactgtgaagaatactttcacattttcaggttttaataggtttaaaatgactggactagagagaaggaaggttttaagaggttgagaaagaaaaatgggctgcagaaacactgagtcatgccagaacctgtaagcccaaccttcttctcccatgtacacacatggcctgtgtggtagggcaatttttagaattgcaattctaagatgatagaactaatcttagggggatccaaagtactatacaggcatatttaaattctattttgcaaccttttatctgaaaatgtcagatgatatctctgttttgaaactgcaaaagcagacacagagggatttagcactttgtttaaagttgaactgtgagtcagtgcaggacaaaataataattgctatctttagtttcacatgtactatctgccaactactgtcttaaaacatcatatgcatttaaactttatatcaacctatggttatattatcatactcattttacagatgagaaaaatgaggctcagacaggtaatttttttttgcccaggggtaataataaaaggcagaactgatggttaaccagggtctatctgacttcaaagcctatgctcttaatcacagtgctataccaccctcacaatgtctcctttgtctgcctaagtggttcttttactactttgatttaactgacttactgtcttaaaaggtgaaaaatttacattttcaagaaacattgttatggatgatctttaaagtagacctctaaggccagtggataggaagcattgctgtatgcattctctaaaggaagggaacaaaatgctcaaagatgagataatttgcatgtggccacaggaatgggtgagtcagtcaagacagagatgtagtctgtcctcccacttcacctgtatactgatgtcaatacagtcaaacagaagagttaaattaacaccggtggctacatgacccaagacatattattgttatttttattactattaccatttaagcttgtatgaaaatatgtggcccatttaaaattagttactttacattaaattttgtcaggtcacagttagtaaaatttagagagggtacatatcgtaacaataaaaatattatttgacgtaaatatgctacatatgtaatttcaacatatgttttctcatttggtactttacaacactgagaatcagataattttaatattaccatgactttacagctagggaaaccaaaaattaggaagactgagacttccaaatctctgctaagtgactggtagagctggaatctgagcacacctgttctcacatcagccctgtgctttctagtcctggcttctgccaggtcatgattctgggatcagaagtgcttctttggtgaagcacagataacttaccttggctttcaaaaaattactttatcttagtgtttcaactttcctaattcagaaaataccaaagataataaatgaacactttaaaaatatttcaaaccaatcttttaattatatagtacattcaagtcattattaggcatttggggatacattatttgattcaacaataaagctatatttggccttttaaaaacagggtaatgaattcttgtactaaactgtaggacaactggcagctgcctgactcaaatctctgaattggatgggtccgaagatgaacgctttttaaagttttctttactagttgaatccctttttgcactggaagcttaatgcagacccttgatgtttggagcagaattgctgtgggtggagtgggatagaggctagaagcttcctctaccttcctgtcttttattcccttaggcatacgtgaggcatctgagtggatttttcaacccaccttaaagctaatttttcattatgaaagaggaaataatgacaatggccaacttttgtggtgtatttactgtgtgcctggcatggtgccatctcccttgtgttactttatttaatcttcagaagaatcttctgagttaggtcttatcattatctccatttgtgggtggggaaatgtagatttagagaaggtgagtaactttcctagagccacctaactagtaacaggcagttaggactaatcccaagctgtttgatgcctaagcccaagtctttatccactaaacaagaaaatggaagtcatttgcttaaagtcatagagcttgttacaaagaggctcttgactagaaccttggtcttctgatatattaatattataattattaattgtatctcaaaattatgctgctagagaaaattaagttaaaatagtttaccatctttcacatatacagaatttgcaagagaattagtaaatacacgtcttcatgtcctcttttcccaaagatcattatgtgaaagtggcaatttcccttgattgcaacaatctgttttgcatattataatagtatcggatttagctacgagtgacaggaaacccagagtaacaggggattacataaaatggaattttattccgtttaatgtgaaacaattctggagataggcaggtaagagctaatagggaggttcacaaaataattaggaatctagtctcctactattgtgctgtcctaccagcttgattacgtgtcttccaaatcctggtctactgtggcaatccatgcttcaactagcacatatgtattctaactatgaaatgcacattaggattccagccaacaaaatagagactccattggaaagaaagtattcatatgctgactcttatggacaaggggcactatttgatttttctggtggctgtgtgcctaaccaaagatcaaggtttctgttattagaaaaaaaagaataaatatttgggataggcgtctaggagtttctagtatagctgtattaagtttgaatggtaagaggtatagcccattgtgatgaacataggctggtggatatatagttttgaagtgtaggcaagtgagctgagctgcagttatagatttggtagtcatcagtatatagatatgaattaaacgcatggacattggtaactaaaagtatttgttcttttgggtaaaataatgcatttcttataatttttatggtattaatttgcacagaaatcctactttattctaatatgaacctgagcttatttcactatgttattattaaatgccaatatattagaacgtaattgtcaaggtgagtatataataaaaaatttcataaattttatgtaccatccaaaaattaaaactgaattcttacatatatttcaggtcgataactggggcagaaaattctttaatcaggaaaactcacttttcattttggaagaattatttaaacatcgagagggtctatacatttttcaatttctcctcattgctgaattaattcagatagaattttgttacatgtagaaatttctagactgtctaaagaattcttggtgtatggtttagagtgctttctaaggaaacagcaagccagaggacacaacaaggtgtcagcatgtggcccaactgtcacattcaggcacattttaatcagggtctagagattttaaaaagttggtgtatagtagttatacatattttgggggtatctgtgatattttgatgcttgtatgcaatgtgtaatgatcaaatcaaggtaactgggatgtctatgaccatcttgtgttggaaatattacagttctcttctagctattttgaaatgcaaaacaagatattgttaactaaaatttccctactgtactgaatggtagaacttattccttctatctatacatttgtaccccttaaccaacttctcaatacaagtagtaaagtatgattttcaaagtctggctttctcaggtatggtatttagattgtttcaaataacttgtagtctcttagtttgactgcaaattatttcaaattatctgacattgtagtcaacagaaaaatgaggcatttgaaaaattgcctgaagtctgattgtttaacaaatgctgaattttaattaggatatgtaactttttgtgttatgtgaggcatggaacattagcttggatgaaaattgaagaccatttagatcaatttaaatttccgctgattttttaacatgtgaagaaaaggagagctctcaatatcatacaagttggggctcaggggatgctggaactcgtttgatgtggagtatgctctcagatttctcatctgtttgaactaacactaagacataggttactggttttacagtttagatctacttccattctatcatgcaaactttcttggagtcatctagacaatgtcaagaagaagatttggtaggaagacagctaaaattttaaaaagtttctgaaagtctcaagctatatattagcagccacaagagtgtctctagctcaggtttctcaatcatttttcttctgatacacttgcagtgatatcagcacactgcttgttaattcttatttttcttccacattttgaagtgtgtaaaattccctatgattggctgcaatggcatcgctcgttaactttgctgtgggatattgttgtgtataaagttgctcaggtaatgccagtttattatcttgaactaaaaagagtttgaggaaaagaaagcaaatatattagtagaattcaaacttcagtagcttagtttaagtctataaacccataactaattacttaataatatctttaatttttttgcaacccacctatctgtatgtagttgcaaatttctagagatcaggccaagtgtcaacttaaatatcagtttgtagtcacctgtgctgtaccatatttagttgggaacttaataaaaccttgatgataatcacagtggaggtcagagacattccttactgttgagttgccactaatatttatgtagtacacctatctaacaaagtctattgatatcatatgcaatcttcacaacctccttttaaaggtaagggaaagatactgtcacgtaagttttatggttggctaaacagaaatagttaaactctgggttttgtaacttctctatgagaactagccgtaattattatggtagggaatgcaaacattgtgattcagcccaagcgcctggctgatgctatcagatacttatagatgtgttttatcttccagtggataggacagaaatatgttatttgtaattttatgtggagtaatttgcttgtatttcttctttttttaaaaaaacagcaatgaaaatatataatccatgcacgtatatatgatattctgttttatttctactgtggatatttttatagtcctgttctagaaagtgtgagaaggattaattatgtcaccaatgcttgctggtttgggcttttcacaaagtaaaacacatctcaaatacttttgttgataggataagcaggcacaatcctatgagctaagctacggtcaaatacatatcatatgccaaaacaaatatatagaccaatggaacagaacagaggcctcagaaataatgccacacatctgcaaccatctgatctttgacaaacctgacaaaaacaagcaatgaggaaaggattccctatttaatcaatggtgttgagaaaattggctagtcatatgcagaaaactgaaagtggacctcttccttacaccttaaacaaaaattaactcaagatggattaaacttaaatgtaagacctaaaaccataaaaactctagaagaaaacctaggcaataccattcaggacataggcatgggcaaagacttcatgactaaaacaccaaaagcaatggcaacagaagccaaaattgacaaatgggatctaattaaactaaagagcctctgcacaacaaaagaaactatcatcagagtgaacaggcaacctagagaatgggagaaaatttttgcaatctatttatctgacaaagggctaatatgcagaatctacaaagaacttaaatttacaagaagaaaacaaccccataaaaaagtaggcaaaggatatgaacagacacttctcaaaagaagacatttatgcagccaacaaacatatgaaaaaaagctcatcatcactgttcatcagagaaatgcaaatcaaaaccacaatgagtaccatctcatgccagttagaatggcgatcattaaaaagtcaggaaacaacagatgttggagaggatgtggagaaatagggacatttttacactgttggtgggagtgtaaattagttcaaccattgtggaagacagtgtggtgattcctcaaggatctagaaccagaaatactatttgacccagacatcccattactgggtatataccaaaaggattataaatcatgctactataaagacacatgcacacgtatgtttattgcggcactgttcacaatagcaaagacttggaaccaacccaaatgcccatcaatgatgtctgttatacgtatctcatttcttcttcaatgatagactggataaagaaaacatggcacatatacaccatggaatactatgcagccataaaagaggatgagttcatgttctttgcagggacacggatgaagccggaaacatcattctcagcaaactaacacaggaacagaaaaccaaatactgcatgttttcactcataagtgggagttaaacaatgagaatacatggacacagggagcagaacatcatacactggggcctatcagtgggtggggggctaggggagggatagtattaggagaaatacctaatgtagatgatgggttgatgggtgcagcaaaccaccatggcacgtgtatacctatgtaacacacctgcacattctgcccatgtaccccaaaacttaaagtataatttttctttttttaaaagaccaactattgattggtggtattgctgtgaagaggcttcttctggtaaatttttctttgaaacactgagccttgacttgtcattttccagtgcttgccattagctttatttgcactagtacattttccccttgtctttttgctgttgctgctgcttttcttttttagcactattctaaaaattacacattaataagcaataataataatgcagcctaagcatattgcttgttttctggcaatttggggctaaaaaaacaaagcatactttaactgttatattcacttgacttgtcactaattatacatgtctccagattgaaaagaaaatcatataaagaaagaaatttgatattactaaagctgttagaattcaatcagtctatctgaaggtgattttacacgaataggtgcacataagttttgatagatgaaaatattgactggacaagtgtttatgtatgttcaggaggaggttaattatacaaacgtctgttgatatgtaaaataaatttattccttcactttactactttctttgagcatacttttttcacatctaatttggaggaattcagtattgaatcacttactgagaaaataaaaaagtaactaagaaataggatcaattatatctcaaaaaagctaaaaaatagggtgaatcagtttgaaaaacaatgctatacagactgggaaaagaacaaataatgtttcaagtgacaaacatcttagtaatgtggtcattaccactattactaataattaaaataatgatgatgataattatcatcctcgttatttgtacaatgatttttccacttgggagctcaaagtaccaaaccgccttctcatttttatctctacctagctcattaggttaggaggggtctggacttattatccttgtttttcatatggagaaattaagacagataattgaatctctgcgtacaagactatataataaatgagttggtggcagggctcagaaatataatctcttaattgtttattcaaagtatttttgactggattctctttttcctttgtcccatattatcccttttgtctacttctagccactcaggagagcatgtcactaaaatagttgtgagtaatgtggaaaggtgggggtcagaagaagaatcacagtggtaccttggacactgcagtgatgtaaattccatgaaaatacatatataatcttccttagtttttttttcatattttaagaatgtcctatgtctctcgctctcttttttttaattcaaacgccataatgttgttcttaaaaaatccaccataaaacaaacaaatccataaattaaaattaaaatttctcacttatttgttattcggcttcttactaataaacattggttgtgtcttctatatattttgttatgcacacacatatatagtttcattatttatgaaaaccgaaacatgaaatgcatattattctataactttttaaaattgaaacttatcattaacctttttaatgttaatacatgaaacctacttcatcaatagaatggctgcattgcttacatttttgtcttgattaaaacttactgtagaacaaatagaacgtgtctaatatttcacaattctatataacaatcatatacttttgataatttcatgttttctacaagcacacattcattttcttcatctgacatgttttgatattagttgagaaacccttctctccctgtattccccccaaagttttgcttacgtgtgttatacccatctcctttcttctgtaacagattaatagcaagcattcagggatgaaggaagaagagtcagttttgggggtttcttaggctcagttgcacataaaacataatctcattgtggagaagactttttatattgcagtaattgacattctaggaacaggtgtttggaattctactcaagggaaaactggagatgggaaaggttgaggagagtaagataaaagcttccctggttacggccccgtggaaaaatcacaggaacaaggcaggagaacaagcagagcccctggagccttccactacatctcagtccctttcccagggacaggattatacagcgatgataacaccattgacttctatgccaatgctctttattttgtgtccagccagagccaggatctaatgatggtgtgacaggggccaacatgataatattatcacttcctgatcctatatcatcaggaaacagagcgttcttgttttctgtaaacaaaaggcatttattgtgaaatgctttgctgtttacacgttcatgatctaattttaggtcccaaagtgctttagacggaatggttatcccgccccttactgatatatggggaaattgagctcagagtttaaatgatttttccgtcgctgatctgttaatgaaagggctgcacttagaattctccttattctgattcaacacccagtactcctccaggagaataccatgttttcctcaagtcctcatgtagcagacagttagcactctagaaaaaagaaaaaagcatagcacacactggcgtaaatacctcaagaaatctaaaataagagtatcatattcaaactccttagtcatctctgacttattatttcacatttctggctttagagtttgcttaccaaatattataacccaatgggacagcaactttaccaatcaaacaaaaatcatgtggatcaatgtttttcagtaacatgtatttttgaaggcagaacaaatagaagttgagggaatctcatgcaaaaagaatttcctgtagctttttttttttttttaagacggagtctcgctctatcgcccaggctggagtgcagtggcccgatcttagctcactccaagctccgcctcccaggttcacgccattctcctgcctcagcctccagagtagctgggactacaggcgcctgccaccatgcccggctaatttttttgtatttttagtagagacggggtttcaccatgttagccaggatggtcttgatctcccgacctcatgatccgcccgcctcggcctcccaaagtgctgggattataggcgtgagccaccgtgcccggccttctgtagcatcattaaagcttaaaggtaaatattagctcaaaacctcaggttctttaggaaggggcctctggttgtttcttctatgtatcctcaaagtttggtttggaaatagatcagaaaattagaagaatagaattagcaactccatgtgaaacctggtatgcttcaagctgtaacacacttcaaaggctatttaagattctagagtgctagagaaaaggcttaaaatatttttgtagcccctgcagtgtctaactctatatcaagtacatggctggctcaacaagtgatagctaacatttaatattgcacttttctacatgtcaggcattgttacaggcactttatatgtagtacttcatttaatcctcacaataatcatatgaaataggtactatcattatcatcttccttttatggatgaggaaacccaagcacaaaagtcaaactacttgcctagcaacaggagtcagagtcaggactggcctcagcagcctggaaccagggtgtgctctaaacccagacagtacacgaccctccaactgaatgtcctttattcccccaaaatatctgttttgtctaatgagtggatgtgttgcatgctctgaaataatctatctatttattttcttccttaggccagatgtggtgagggctaggaaaagagtttgttgggaaccctgggttatcggcctcgtcatcttcatatccctgattgtcctggcagtgtgcattggactcactgttcattatgtgagatatagtaagtataagctgccttggcatcatgtgatttaccccaaatatttcctcataccttgctgttttgatttgcctcaggcttattcatttatcactacgattcatttgcatagcctgtacaaagggatctttacctgctttctctcttatttagtcctcataagtcaaggaggattcttttttctatctttgatgtagtgatgctttctgctgggaacagcatgcttatttgcatcttccttaataagcaataagtgagtattaatcaaaggaaaactacaggatagctagaaccaatgtcttgagttgtttgaggtcacagggcaagcatcttgatttaaaataattctgaccgggtgcagtggctcacgcctgtaatctcagcactttgggaggctgaggcgggtggatcacttgaggtcaggagtttgagaccaggctggccaacatggtgaaaccccgtgtctactaaaaaaaaaaaaaaaaaaaatagccaggtgtgatggtgtacacctgtagtcccagttcctggggaggctgaggcaggagaatcacttgaacccaggaggcggaggtttcagtgagccgagatcacaccgctgcactccagtctgggcaagagagagagactcggtctcaaaaagaaaaaaaaaaaatccaactcgttgaagtcctgacatcccaataaatcaatgacacaatctggagtcataaagaagtaggctctattctgtaccagtaagttacaaaaatagtcatagtgatgtattgttgagtaagtgcctatttctgttattaaaatctcatcttaggatatattgtaagtgattaaagaggatagggtatgccaagaaagctaattataaagatgttcaccctgcggttatcaggtacctcattgctagatgaactgttagttgctatgttattagaaaggtctccagggtacttcagaactgttattctgggatgtaacagcccttctgaagtttcctcctactctgcctagggttttaattacttgactcaaccatgacctgttagtttaatatcttcctctgttactagattatacttggatgttcaaggcaccgtaaccatagaagctaataacttgattctaatttaattgggaccttgttgaagtttctttccagtaacgagaaagagtactctgtaacctggttatcttcctctactatccacgcaagtataatctcaatttacaaagcaaggtggatcatttctggatagtttaaaaaaatatttaaaacaaagatttttttggtagaatttgcatacaggcaagtctttaaatttggagtatctgcatattaataacagatttttctgtagcacactttttttttgctttttgagacggagtcttggtctgttcccaggctggagtgcagtggctcgatctcggctcactgcaacccctgcctcctgggttcaagtgatttttgtgcctcagcctcctgagtagctgagattacaggcatgcgccaccacacccggctaattttttctatttttagcagagacagggtttcaccatgttcgtcaggctggtctcgaacttctgacctcaaaagatctgccttccttggcctcccaaagtgttgggattacaggcataagccactgtgctgggactgaagcatactttaaataaaaatgaattgctggaataactttatagttctacagttctgctgagaatattgagtcctactttgttgtaagcatcattatttgtccccatggatgtctaggactgttttacacacttttgtgtgtctagaatttatcagaatcttggcacatgttatgtgctttataaatatttattaaatactgaatgataatatcaaatgaatcatgcctacaatattttcttgggccatacttcggcttgtctgacttcacaaggaattcctagtaacactaggggctaatcacctcagtgagagaaaatgtccctttctacttctcatttgcctcttcccaagccaagttttataagattcataaatcttagtcatatgtatacagtgaaaacttggcaagaattttttcagtaacctgttcctgaatcctgttgtttggatgatcaactgagtaatactgaacacacagcttctactgcccacacagtacacctgaataaacagtgattgttgtgatgtgtgttactgccttctatttgtgacctgctttctgttttgggatgtaaactaaccgagtggctttggcagacaaatatttagaagctgacatgccaaaataaccaaatcaaaccaaaccaaaaaaatctgtcacagaaatagacagatacagacaaaggtaatcagatttggaaaaatatcattttggttctcatttcataaagcccaggacaatgtagaattctgtgtatggttcgtgtctggggcctttgggggtgcatttctgcccctgtgtaatttggatgtcagaagatgaatctgttataagcaacatcactgcagattatagaatcacaaaactgctagaaatttaccaacaaactcatgtttatccttatttttaacttttctgttaatattcccaacatattttagtaactactcataccatatatttatggcagctggtaatatgttttaacagtggcatgcttaagtctacagggtaaagtaaaatactgagcacagataataaattgttaacttggttaaaccatatgaaattgccaatatttgactatttttgacctgtactaatggtgattttaaatcattcaatctaataagccaaaaaactacatttaagggtgtagaagggtctgttagcattctgtctagaatcttgctatttaatatgtgattagctaccagaagcatcaacatcacttgctagcttgttagaaatgcaaaatcttgagtctaactttagacctcatgtaccagaatgtgcattttaacaggctccctaggcagttcactttcacattaaaatttgaagcagaattctagaagaatggatacaactccacagagagttatagttaactatgaggcagatgttaaaaaatacaaatgtagtagaacagtagtttacagagatagttatgagttatttcccagtatttcaataaatttaaaatcttacttgaagttatgtatatttccaggtacctgcctgaatttcatgtcaccctggccattcagagaaagggaggtgaggaaggatggaggaagagtaaaacctcccaagtccttcacttaggtctcttgtactctggtgactcaactttcagtgtctcctgcctgccattcatctcttttattcatcaccaaccgcacccaagcccttgtcagagtctgatggctgcttccctctctgtcccatcaaatcctctggatggccagggtgttttatttgaaatacaccagtagttttttgcataacttttatacaacaaaagatttgtcctctagctttaataagtggctttttttcctactctaagaagcagcatgtgaagtaagtgggtactttgggagttagtcttggctatgtcctgctggacttgggcaagttatttacatttccaagactgtaatctattaaatgtggataacattgccttttcatggagttattgtaaattaaatgagatatgtgaatgtactagggacactggtgtccagtgttagtttccttttcttctgtggtttaagtgaagagggaaagaatagggaggaagagaaaggaggagagagactgtgactggatgagccacagtctgctttcctatagtaactatatacaactgtcttgatcaccagtgtatttctaatggttgacacagtgtctcttcctgaaaagtggttggcattaatatttgttgaatgaatacattaattttctgagggctgtctgcttgctttatgcactggagggtagaggaaaagttatatcacattaacttttcagcaggtcaaaaatgtgggttgcttaaattgaatgcagaatgtagagacagtggctaaggagcagacaagccaacccctgtggttggtgggaaaaacatacatgcagtgacaaaggacccaggtgaaactaaatagtgtccctggaaggttatgccaggtggcaactttagctccctaaacttccatttactgaatcccttgcattttaattcctaacctcatcttccttttcagccaaaataaattttctcaaactagagttcttgcggccagaattgatgtatagttgatggaagggaaaagaaaatctatgtttggaatataaaaatgcagtgacccttgggaggcttctgaatccatccctgtttgtatgctcagatggcatgacttgctgtctcttgtggcttacttaggaatgagtaacacatgaataatcagcccactgttccaatgagctacttgtacagtactccaggaacaccaggcatttcttacagcttttattctctaaatcacatgatgataaatgttgttgttttttatcctgagataactatgaggcctggggcaggatgatgatgatgacctgtgctaagagcattccttcctgtttcagtcttccagcaaccaccaagcggggatataatgatgctttacacacatctgataaaaattatgatagtgttttgcttctttccttgtagatcaaaagaagacctacaattactatagcacattgtcatttacaactgacaaactatatgctgagtttggcagagaggcttctaacaattttacagaaatgagccagagacttgaatcaatggtaagcaacttgtcatctacttctagtgcatttgctttcactttttaccatatttttagcatcctagcttctaaaagatccattcaactaacggatccctgtgtatttgcaaaatgaaaagaggccctaacccaaggaatataaaacaaaatggacaatacatcacttagcacaatatgactcacagggttgaaccaaagaaactttagccattcggtcaggtccttcttactcacctttccttagctagtgatatactcttgatcagtagagtccagagattctggaaatgtgagtgtggcttaaaatatatttgttgtatcctagacttcctaaaaaagagaccccgagcagaagattgccaagattgaaactatttaggcacatacctaaatagtctgttaggttttaaaaatatctaaccttcaaccagcttttggtatataaatctgtagtaaatccacagatatgcaactctacccagtttttaaaaatatttaaccttcaactagcttttggtatgtaaatccacagataagcaactctacccttaacgcatcaacattcatcttgagggatcaattaaatacttaagaaactggaaaaattagcagcatgggccaaaagaacaagggcctaagtggtaacttcttgtcattatcagattaattaaagaataatttaacttttcctggaaacctgtgaggtaattcatgatataatgtgatggaaagaacactgaactgggagctgggaggcacatgtatctccaatggtatctactaggtaatgatacatcacttggaatattagtttatcattctgcacaaagttctgtaaattgaaaattaaggtattaggttagataatttccaaattgtcttccagttccaataacctgaataagaatggaagtgagaccctggaaaccgcccagtagacagaagcctggggatttggccaccttgctgagacagtggttgaatcctggttacatttgcacttgcaaacaccaaatcagggaaatatttgaccaggctcttctctaaggctaaatacatatgcaaaatgaaggaaatgaaattgaattaaaaaggtcaagaagagatgccactatttcccttgttctttgtgccattcattcaaataaattttatttaagtaaataaaatccagacagatttaaatctaaaggaatatacataaggctctttaatgccttcaaaattaataatagttttgaagttacttgacaaaaattaacccttaaataaaaattttcttgtgaatactgccatcctattcagaggacttctgctattcagctttgtctcataatcgcaagaagtgtccttagtaaaaaaattcggaattaataaaatgtaagaaagaattaaaaggctcattgcttctgttaatcaccagcatgtagtaagtgtttactaaatatccacatactggaaacaagacacctttgagtgtttccttacataaactcctaattaaaaaattaagttgcctagaattcttatttagaataataactaacgtctctacaaaaatagactctttcactttagtagagtaaaactcataggtgtgttaggctaagtatcccagttcacctgggcctttctaagagcacttggagtgctgaacttcgtgtacattatgccaggaaaactgacaactttgtcactaggtttgggaagcatttgacatggtcatgcactcatttctataatccaagtattatgtggcagaattatttcatttcctttgtctatgggcagtaaaagtccttacttcagagtaaaatttctcactcttaattttgaagaaacagcatgttcattttctttggtctctttctgagcattagtacagcagatatcacttctggccccactgcggttccctactcctatcattcctaagacagcgttcagttgaaatcactgagaaaaccacaatagattcctcaagcttcctcagttccactcactgtgaaatgtcaatgttttttgctctgttttgttttttaattttctaaaaagctttgaattaatttgtggaatttcagaaagttgttcttgctgatatattttgaatatttttacaaacaggtgaaaaatgcattttataaatctccattaagggaagaatttgtcaagtctcaggttatcaagttcaggtatgtaaatctgaattgctgacttctgaatttaaagttgaagctgttaatctgctcagcaataaatatgttttcaagtgttaaagatataattcaatccaacaaacatttgacacttgtcctgtgtaagtcatgggttacaaagtcccttattcattccttaaatcccaaagtaagcatttgcaagatggttgctggggacagaggtataattggtgcctatgttataaaattgttttctgggaaacttaccaagtacagatagtactaaatacagatagacctaacacacatccttggtttaatggcaagtagtgccccatgtaagacaatatagtagatcaggtttgtctttagctcttcttcctcctattaatcaatcttctttatcttcttctattccatccctccattctcaaaatatgtagctgagaaaatctcatctgtcaactaactattgataaatgggtttagtacataatgttaaggaaaatattataagaattttcaataagatattgacataatacaaattatttgtattaaaaaacagaataagaattatttccaatattattccaatgacaaaactttaaaagtttcctgccattctattacttagctgatatctctaaggcattactttgatcactgtcttctaaaaattctgtactctctggtgtttgagatactgccctttcttggatctgcaactacttctcttatctttaagtttcactttctcaaagggacctcattcacccacatggtctcatatgctattgaaatacaagtttctatctctagtctgaactatttttctgatttctataactatatacacatccccatgtggaagttccacagaaaattccctaactcaggaagaatccaatcacataaatgagaaacctggaagtcatcaaacactccttcctttcctggtcccctcatactttatgaataactaagttccactaattctattttcccaataactttccaatttgctcacctctttattccagtaatcttgctactgctactcattattctgtcttctgttactgcaatagtgagaagagcaagtttattggaaagatgaagtcaattttggagatgttgaatttacattctaagggaccatatgaacctgaaaaatgagggtgactcagtagagggaaatggaactgagcagaagatagaaatttgctcatgatcaactcaaaaatttggaagcatgggtgtaaatttctcagaaaaagaataataaaagggaatgaaaaggatgacaaagaaagcttgaagaccaatatttaaggtgatggaaggaatataggaaacttagatatagggaaagagcaggaaaatagaaaaatcatgacagaatcaccactgatgcaaaagataagaagtttcaaagagagtgtggtcggcattgacaaatattcctgactgagtaatataaatattgaaaagaatccactggctttgtcaactaggatacttgggttgttacttattttcgtgtcctgaaaatagtgttacaattaacatgtttataggtatgtccttgcacaaatgtatgagtgcatttgaatgtttaatttctagaagtggaaatgctgtgccagagaagacagatattcaaacttataatagataacactgccatccaaaaataagactctaatttgtattcccacttccagtttatgagagtagtggttgatgcaatatatagtgaagagttagattcagaagtgactatgaaaaggagtgggtaaagtagctggcaggatgattccaaggtagtaattcatacaaatagtattaagactaattaatgctctgtgttgaaaatacagtcacatgaagtcagtacaatttggtaaagcggtcttatatctttaggattaggagttgtttaggatagcctgaagattgtttaggggaggtaagtagacttgagtcacaagaataaaacctgaaattcaaaaccacagttgatttcatatttaagacacactgtatttgataattttgaatggtttttgacaaggtgtctttttatattaatagccatatacttaactagaccttttgatggtaagggagaccatgaacagactaactcactatatgagaggctgaatttgtggttcttcacatagtaaacagtagcaatatagaaggaaacatttatggatgtattttatgtgtgcatttcatgtaagtgataaagaaaaaagcagattgtgatattacccttctttcttttcttttctcttttcttttctttctctctctctccctctctctccttcctcccctccattcccttctcttcacttcctttttcctttcccttctccttccttccttttctcttttctttctttcctccctccctcctttcttcacttcctccttccctccctccctccctcccttcctgcctttctttcttcttttcttttctttctttcattttcttcttttttggcccacagtcaacagaagcatggagtgttggctcatatgctgttgatttgtagatttcactctactgaggatcctgaaactgtagataaaattgttcaacttgttttacatgaaaagctgcaagatgctgtaggaccccctaaagtagatcctcagtcagttaaaattaaaagtaagttaatttctcttatttttctttcatagaacagcttcatgttaggtttgatcttggcacttattaaaaaattttttttgatgtcctttaattctggggtcttgccaccaacagtatatttctttggaactaaatttgtcctaatgaagtattttaatttttaagactaccctaaacttaggcctcccatgcaagctttttattaactccttagcagttttctttatattacactttatagtttggctatagaatccaattataagtgaagaaaatggctttgtattttcttctttttcttgttgctttcattgtatgttctgagggtgtggtatatggaaaggttcatgccatttacacatttgttttcaaatgtcattaatataccttgctatactttcttcccttaaacttttcaccagtgaaacatttataataaacttatttttggtatatttacaactataaatgaaaaatttaggtagatttttgttgttcttgttgttattgtttgtagggccacatgggacaaaacaagtgatgataggtcctcacatttagaaaataagaaatatgagatcctcagtggaaattaagatctggctaagggctggttcatatgttacagaacaatgaaggtctatagaaatactatctgggcacaagtataatgttacattttctagaagttacattaaaaataaaaataaacatgtaaaattaattttcaataatttgtatattcaacccaatatgtccaaagtattatcatttaaacaaatagtcaatgtaaaaattattcatcaaatatttcacttttttttgtagtaaggctctggaatctagcgtacattttatactgatagtacatttcaatttagactagccacactgcaaaagctcattggccacaggtggctagtggatacagtagtggatatggcagcactggaaactacagagtaggggacaagtagagagaatgaatacaaactgctaatataatatctgatagatctaagtagatgcctaaattgatggccagccaacccacttgcttaggaaggaggcttcagtagtcagggacagatacataatttatgcgccttagcacaaaatgaaaatgctagacctgttttcaaaaagcaagaaaaaagtgctgttaaaagtacaaagatataacacttttctttcttccctggtctcgctctcgactttccatggtgttttcatttgctgattattgtcattctaagagaaaaaaattaaatttgtagattactaatatgagtttaattgtttatatcatgcaatgtcgatataaatgcatatataagtacatttaacttgtatttcaaatcatggaaattatgcaactatatttcgtagcttatacatacatgtttttcatttttgcctcaatggaaatagtacaaaaggctaatgactctttttattttcctggttaatatgagaaaattctaccaacactctctaccttcagcttattgaggggtgaggaaggactagaaggaaaaggagatctggatttccctatctttctctttctacattgtagttttcagcaaaagttgttggctaatacacagaagtaacagaagcaagaaaggatatggcaggatctgttgttcatttgtgtttattagaatgctattgtcttttctatgggttctaagcaagttttggttcaaacagaaaacatggcctccaaggcatgtcagtccacctctgcttacttaatggaagggatagcacacttaccttgtacttgctttgagtcttgctgaacccctgtggattgtgggtccactagaattctgatttcatagggaattgtgaatgatatatgcaaatggagtggaaagaaactatggacacacttattgcacatatcttgtctgccaacactataatccattatcctattgaacttcattttcaaaacacaagttacaagataaaattattaagaatgtcaagtgagcaatagcagagcattgtaccaagcacaaggccattgtgagtgtgagacccagtgcagatgtataagtcacacatgaagccagccttgtcagtgctatcaatactcagagcttgacattttcctaggaagagcttgagatagagaacaggttatttgaaacaaagagatcagaggtggtccttttaatattaactgagactaaattgtaaattcttccttatttttgccattttccccacaagtagccagaataaataaagtcagaaagaaggccttctagaatatagatttccacttcattcatactattaaatactaaagaaaaaaattaacactaatatttttgcatttagagcatccatccttccatgtacaaagaatagttttggtcattagaactctgctgagtcagaaagtttgagcttagagttttatgtatctattagctgggttagtgtttgcatagggtttgagactgactagtgagaagtcagcaagctaagaagtcattggctggagctaaatgacaatttgagggcagactgtcttttgaaatttgacttcaaaaagggtaacattgtttttaactgtgagtgagtacaaatttatggagatgctactcaggtgtgttatacaaatgggactaggcttatgagctcaatgatacaatctgaaataatggttaataaaggtattgttacatttggggaattaatactatggtttagagtagtatttcccatggaggggctgtggactctctgcatcttatttactggtataaaatccaaattcttgggcgtcattacaagctactgaattagagttactgggaaggtgaacaggagtttcattataaatatgcttcctatgtgactcttacccacattaaagtttaacacaccgttcacattctctgcaatgtgatgatcatcctatgtctatgacaagctatgttgccttctttataatctagagatactgttttataataaaattaagcagccttttagtatttgaaatactcggaggcatagtgtaactctgatgtgctgaccctatttgccatttctgtgtgtttcagaaatcaacaagacagaaacagacagctatctaaaccattgtaagtttaatatatttattgaaatagcattacctgaaggtaaaaagctaacactataggtcatttaggtttactttgtgttgatatcatagggacagaacacataaagtttgattaatttgtgtacagttcatggtactttatcatatcttggagatacattttattagtaaaggatagcaaaattgagataactttggagtggatgtatgggtgcctgtggcagatgtgtagtggaattgagttgtacagctgttaaagaagaggcaagaaatgtttacttatcaatgttctgtttgtaggtatctataagataaaacaaatctatacattgtgtttttcagctagaggcagaaactcattgtcactatatcctagataaaatcttcttgatgttattaatcctacggattaatacgaaagtgcaggaaattatcgggtcgtggaagagtcacagaaagtgcaggaaattatggggtatattttaataaaattactgaagacacatagataatatcttcacctatattataaaagtgctgagtctaggcctagcacttttcttctcctatagccaagtatgccaccatgatttacagtatacattcaatagttatggggttgttgcacattacatttctcttaaaaggtggaaaaatatgtgctactcaccagctcatatagttggttaatttctaaaatcaactaaacacaaaaccaaaagataatctcattacctaaatagcatatattctcaccaccaatatttattgggaacctaccatgtgctagcactgtgttagacaacaggcattccaaatggataagatataatatctctacctgaagcaccttatactttaatgggactaggtgcatgagactaattcatgaacacatcattcttaaacaacacttctcaaccaagggaaatattgttggccaagctatcatgccccactgtggcatttttgtcatgaatatagggggagggctactggcatctacagtggatctacagtatataggccaagatcttatgatgcacagggcagccccctacaacaaagaattaaatggttcaatatgttagtggtgctaaggttgaggaaccctgtcataaacaatgtcagtatgtatacatacacataagcacacatacagagtgtgtttgttatacacataagcacacacacagagtgtatttgttactattattattttggaagcaccaagaaagtaataactaatccagattggagacaggggagttagagaaagcatcctagagaggtaacaactgatttagattttacaaaatgaacaggagttagctaaataaaacattacagtttacagaaaggtaagagcatgagaaaacatttgatacttttggagcacaaagtagaagaaatatgggacatagtaacacaatttgatgtgcaaaacaactgctaattaatgcacccaccaatgcaccccccctctctcttttgcaggctgcggaacacgaagaagtaaaactctaggtcagagtctcaggatcgttggtgggacagaagtagaagagggtgaatggccctggcaggctagcctgcagtgggatgggagtcatcgctgtggagcaaccttaattaatgccacatggcttgtgagtgctgctcactgttttacaacgtaagtcttgaaccttgagaatgattgggagtgaacaaagtgcactgggttttggcaagaaaatacctcatgaattttgggagatatgagtttagcataaattaaaaataatgtgtatatcacaaaagactggatcatttgtaaacattagtaagaggttttaaagtctggaaatggaaatggagtcaaagtatatgtaaataaataatcttttgataaacacacaatagtttctcaaagaaagcaggaattttaaagtcatttttggatttgaatttgctgtcaaacaggagtgctctatctctgctgagtaccttaatcagagatggagtctggataggttgtaggtttgatcctaagggggaaatttcacatggtaagaaaaagaattaaatacgaagaattatgtaatgaagatatgaagaatttggaagtagcaagttgtataaatgaatagattgactaattatattgcaagaaatggaggacccttcaatctattgtcaaaatgtctatagtatataaaataataatactttgttaaattattgtgtggactttttggttttcagagaaatgtgtatatttctgggtggggtacatgagacacatagaatatattaatttctcttattctgtacagggtactttccataggtcccttggagtcattaatatacagaaaaatcaaaaagccttagcatttggagtggatgacttggcatatggagtggcatgtatattataggaaatggtggctttttcacctggtcagaaccctgagccttattatcaaattggaaagagttctatacatcaaaactataaaaagaaaaaaaaatctacacctgtagactaaattatttaatataaattattcgactggtagcatggtaaaaagaaatttattcttcatttttttctccccagatataagaaccctgccagatggactgcttcctttggagtaacaataaaaccttcgaaaatgaaacggggtctccggagaataattgtccatgaaaaatacaaacacccatcacatgactatgatatttctcttgcagagctttctagccctgttccctacacaaatgcagtacatagagtttgtctccctgatgcatcctatgagtttcaaccaggtgatgtgatgtttgtgacaggatttggagcactgaaaaatgatggtgagcgtcggaagaggaactcaagtaaaagttaaattggtattttatggcatttaagcaatgaaatgccattatgccaaaatatgttagttgtgtggtcatatgacctggaccaagtcaggccctaaaagtgaagtaaataacttggaaggcacaaaaattccttcctgcctaagttaatatcgagtaaattgctactactatatactacagtcatagtactgctaagatgtctgaaaaagcaaatatgtctcctagccatgaactttctttagagaattaaccagtttagagattagcaatcaataatatacccaattctgaagattggagaatcataaagccaccattctcccctactgaaatttccttgtaatgttaacaatggagtggacattatttagataacttgtggttctttcctaggcacccaactttttgctcaaagtagttaggaacaaattatcttcccaaatattattgttctaaacatatgtagtctaagattctgtatcactatctttttttttttttttttttttgagacagagtctccttgttgagacagagtctccaggctgaagtgcaatggtgcgatcttggctcactgcaacctctacctcacaggttcaagcgattctcctgcctcagcctccccagtgattgggactacaggtgcccgcctaatttttccatttttagtagagacagggtttcaccatgttggccaggctggtctcaaactcttgacctcaggtgatctgcccttctcggcctccgaaagtgctgggattacaggtgtaagccaccgcacccggtatcccccgcttttttttttttttttttttttttaagatggggcttctttctgtcccccaggctggagttcagtggcccgatcttggctcactgcaacctctgcctcccgggttcaagagatttacctgcatcagcctcctgaatagctgggattacaggtgcatgccaccacccccggctaatttttgtatttttagtagagacaggatttcaccatgttggccaagctggtcttgaactcctggcctcaagcgatcctccaatctcggcctctcaaagtgctgggattactggcgttagtcaccgtgcctggcctgtatcaccatcttattcctaatcatgaaacattttcttcaagtttataaaatatatgtatgtctacaaatacaaagacttttttttcttttaggttacagtcaaaatcatcttcgacaagcacaggtgactctcatagacgctacaacttgcaatgaacctcaagcttacaatgacgccataactcctagaatgttatgtgctggctccttagaaggaaaaacagatgcatgccaggtaaacagttttgcccattagtatgttgtgtaattttttgtttacttttctttgaaataattatatatctacaggaagttgcaaagatagtacagaggagtcacaacatctcacccagttttctccaatgattacatctcacataactatagttcaatataagatctgggaaattgacagtcgtacaaagtatgtgtctaattctatggcattttgtcacatctgtagatttgtgtaaccaccactacagttaagatgaagaactattctatcaccacaaagacctacctttttccctcctcctactatccctaacatctggcaatcactaatttattctccatctctataatttttcaattttcagaatgttatataaatagagtaacagtagctttttaaacagaatttaattttggatcatctattggtatttttggcttttttttgtagaaaaattttagtggttcctttaagttatatatatgtgtatataaatatatatttatttatatatacatacataacatcactgtctatgtgtattgaaattttactagttttggtggagtatagaataaaaaacttacttccccttaaatccctttgcttttccctctttaatattaaacattaacaaatataaacattaaatattaataaatataaatattaaatatttgctttatattttgagaaccacagaagacaatgttttgcttcaacagtcaaatgtaatttagaaaacataagaggaaaaggaaagactatttacctatggatttcttctttcctctttcctgattccttttttaaaaacagtcatttctgttttaggaacttcttttagccactcttttagtataggtatgctggtgaaaaattctcctagattttctttgtctctaacagtctttatttcttcttcattactggagcataatttagcactgacagttcttttctttcagcatttaaatcattgcctctgtgatttctgcaaggaatttgctgctattagaattatttttttccaatagatgaggtgtcatttcttgctgtgttcaagagtttgtctttagttttcagaagtttgattatgtatcttggcatggatttctttgggcttatcctgtttgaggtttgctcagctttttgaatatgtagatttatatcctttgtcaagtttgagaaattttcggtcattatttcttaaaatactctttcagtcccaccttctttcttctttccttctggaactctaaccacagcaatgtttactcttttattatagtcccagagtttcctaagcttttgtttattttttttgcactctagtttctctctgtttttgagattgggtaatttcaatgtatcttcaagtttactgattctttgctctgtcttctctattcttatgttaagcccatccagtgagttttgaattttgcttatcatattttttagttccagggtttttctttgtttcttctttttatatttactatttctttgttgacacttcctatttcttttcctttgttttaaacatgatggtaattgctcattgagatgtatttatgatggctgctttaaaatctttgtcaaataatttcaacatttgtgttatctcagtgttggtatctgttgattgccttttctcattcaagtaaaaacttttatatttcattgtatgatgactgatattcagatatatgctgagcatctaattattatttattctgttttgttgttgttgttatatcatgcttttaaatttatattattttatttaattaattactttgcttcttccaacttttattttaggttcagaggttacatctgcaggattgttacatgggtaaattgtgtgttgctggggtttggtgtacaaattatttcatcatgcaggtagtaagcataataaccaataggtagtttttggttctcatcctcctcccaccctcaaccctcaagtaagccccagtatgtattgttcctctctttgtgtccatatgtactcaatgtttagcttccactcataagtgagaacatgaggtatttggttttctgttcctgcattcatttgcttagtataatggcctgtggctgcatccatattgctgcaaaaaccatggtttcattttgctttctggctccatagcattccatggggtatatttaccacattttctgtatccagtccactgttgatggacattttaggttgattccatgactattgtgacaattgctgccatgaacatatgcatacatgtgtctttatggcagaacaatttgtattcctttgtgtataatatacccagtaatgggattgctgggtcaaattgtagttctgtcttaatttctttgagaaatctccaagctgcttcccacagtggctgacctaatttacattcccacgagcagtgtataagcattcccttttctccacaacctcaacaacatctgttgtttttttgactttttagtaatagccattctgactggtttgagatggtatcttattgtggtttttaatttcccatttccctgattagtgatgttgagcatttgtccatatgtttgttggctgcttgtgtgtcttcatttgagaagtgtctgttcctgtctgtattaggctgttcttacactgctataaaaaaatacctgggtcgggcatggtggctcatgcaggtaatctcagcactttgggaggccaagggaggtggatcactagagctcagaagttcaagaccagcttgggcaacatggggaaatcctgtctctgctagaaatacaaacattagccaatgtggtggtgtgtgcctgtagtcccagctacttggaaattatgaggcaggaggattgcttgaacccaagaggtcgaggctgcactgcacccactgcactccagcttgggtgacagagcaaaaccctgtctccaaaaacaaacaaacaaactaacaaaaccaagtaaacaaaaagccaatattaggtaatgtataaagagaaaaggtttaattggcttatgattctgcaggctttatgggcagcatggtgctggcatctgctcggtttctagggaggaagcttacaatcatggcagaaggtgaagtgtgaaatgggagggagcaggtacatcacatggtgaaagcaggagcaagagggatagagtggtaggagaggtgccatacacttttaaacaatccgatctcacaagagctcactcactattgcaaagataactccaagccgtgagtgattggctcccatgacctgaacacctcgcaccaggtcctaccttcagcattgggggtgacaaagcaacatgagatttgggcagggataaatatccaaattatatcattctgctcctggcctctcccaaatctcatgtcttctcacattgcaaaatataattatgccttcctaacagtccccgaaagtcttaactcattccgactttaactcaaaaattcaaagttggccagatgcagtggctcacacctataatcccagcattttggaaggccaaggtgggtggatttcttgagcccaggagtttgagaccagcctgggtaatgtggcaaaactgcatctccacaaaaaaaaattagctgggctttgtggcatatgcctatagttccagctgtttgggaggctgaggtgggaagattgattgatcgtgggaggtttaggctgcattgagctgtgatcgcaccactgcagtccagcttgggtgacacagaaagacttcattttggggaaaaaaaaaaagtctgaagtccaaagtctcatctgagataaagcaattcccttccacctcatcaatctggatttcactgtcgatgtaactatcagcattttggtcacaaccatttaaccagtttctaagaaatttcagacttgatcatatctgtcttctgagccttcaaagttcttccatcctttacctgttacccagttgccaagtcgctttcacattttccaatatctttatagcaatgccacactcatagttaccaattttctgtgttaggctgttcttgcattgctattaagaaatatctgaggccgggtaatttattagaaaagatgtttaattggctcatggcttttcagactttatagtaagcctgatgctggcattaacttggctcctagggaggcatcaggaagcttataatcatggtgggaggtgaaaggggagcaggaacatcatgtggtgaaagcaggagcgagagagagagagtgggaggaggtgccacacacttttaaacaaccagatatcgtgacagttcactcgctatcgcaaagacagcactatgctgtcagggatccgttacccaaacaactcccaccagcctcacctccagcaatggagattaaacttcaacatgagatttgagaggggacaaatattcaaactgtatctatgttttttttccccattttaaaagggagttgtttgttttttgcttgttgatttgtttaagatttcttaaagattctggatattagacctttgtcagatgcatagtttgcaaatattttttcctattctgtaggtcgtctgtttactctgttaatagtttattttgctgtgcagaagctctttagtttaattagatcccagttgtcaatttttgttttagttgcaattgcttttagagtctttgttataaaagctttgttaaggctgatgtccagaatggtagttcctaggttttcttctagagtttttatagttttaggttttacacttaagtatttcaaccatctcaagttgatttttgtatatggtgaaagaaaggggttcagttttaattttttgcatatggctagccagttatccccagcaccatttattgattagggagtcctttccccatttcttgttatggtcagctttgtcaaagatgagatggttgtagacatgcagctttacttctggcttctctatttggttccattgatctatgtgtctattttttttgtactagcaccgtgatcttctggttactatagctttgtggtatagtttgaagtctggtagtgtgatgccaccagctttgtttttttgtttaggattgctttggctattaaggctcttttttggttccatataaatattacaacagtttttactaattctgtgaaaaatgacattggtagttttataggaataacatttaatctgtaaatttctttgagcagtatggccattttaacaatactgattctttctattcatgaacacaaactgttttaccatttgtttgtgtcaactatggtttctttcttttttttcttgagacaaggtcttaccctgttgatcaggctggagtgcagtgccacaactatagttcactgcagccttgaactcctgggctcaagcgatcctcccacttcagtctcctgagtagcggggactataggcattcaccaccacacatggctaattttttaggtttttggtagagatggagtcttgccatgttgctcatgctggtcttgaactcctgagctcaagcaatcctcctgcctctgcctcctaaactgctgggattacgggcatcagccactgtacctggccttcaactatgatttctttcagcagtgtttttaattctcattgtagaggtccttcaccttcctagttagccatatgtctatgtattttattcttcttgtggcaattgtgaatgagattgcactcttgatttggctctcggctaagatgttattgttgtatagaagtgctcctcattttagtacattgattttgtattcagaaactttactgaagttgtttatcagttctaggagcctttgggcagagactgtggagttttctgggtgtagaatcatatcatttgtgaagagagatagtttgacttcctctcttctatttggatgccttttatgtctttctcttgcctaattgctttggtcaaaacttccagtactatgttgaataacagtggtgagactgcacatccttgtcttttctggttcacaggggaatgcttctagcttttgcccattcattatgatgttggttatggggttgtcatagaaggcttttattattttgaagtatgttcctctgatgcctagttagttcaaggtttttttcttttttttctttttgagacagagtctcgctttgtcacccaggctggagtgcagtggtgcgatctcagctcactgcaacctctgtcccccaggttctagtgattctcctgccttagcctcctgagtagctgggattacaggtgccaaccaccatgcctggctaatttttgtatttttagtagagatggggtttcgccatgttggtcaggctggtcttgaacacttgacctcaggtgatccacacatctcggcctcccaaagtgctgggattacaggcaggagccaccgtgcccagacatatttatttattttcatatgttgaaccagccttgcatcctagaaaataagactacattactgtggtggataagctttttgatgtgctgctggatttggtttgcaagtattttgttgaggatttttgcatcaatgttcatcaaggatattgtcctgaagttttctctttttgttgtgtctcttccaggttttggtatcagaaaaacactgccttcataaaatgtgttagggaggcttctctttttctagaattttgggagtattttcaatataattggtaccagctcttctttatatatctggtagaatttggctgtgaatctctctgttccagggccttccctgttggctgtttttttaaaattactggttcaattttggaactcattatttatcttctcaggtattcaatttcttcctggttcaatattgggagtttgtgtttccaagaatttatccattccttctagattttctagtttgtgtgcatagaggtgtttacaatcatctttgaaattttttgtaaaaaatatttctcttccctttggcatttctgatggtgcttatttgaaagttctttcttttttttctttgttagtcttgctagcagtgtatcaatcttatctattctttcaaagaacaagttgtttggtttcattgatcttttatatggatttttgtgtctctatttcattcagttcagctctaattttggttatttttgtcttgtgctagtttaggggttcacttactcttgtttttctagttcctcgaggtgtgatgctacattgttaatttaagatatttatatcttttcgatgttggcattttgccccataaactttcctgttaatactgctttacctgtgtcccagaaattccggcatgttgtatctttattttcattaatttcgaagaatttcttgctttctgtcttaatttcattctttactcaaaagacattcaggagcaggctgtttaatttccatgtaattgtataattttgagagatcttggtattgatttctatttttattgcactgtggtctgagagtgtgattggtatgatttttaaaaatttgtttagaattgctttatggccaagtgcatggttgatcttagagtatgtgccatacatatgcagatgaaaagaacgtatattttcttgttgttaggtggagtgttctatagatatctcttaggttcatttggtcaagtgttgagtttaggttcggaatatctttgttagttttctgcctttataacacctttagaggggtgttgaaatctccactataattttgtatttatctaagtcttttttgtaggctctaagaacttattttctgagtctggatgctccagtgttggatgcatatacatttagatagttaatcttcttgttgaattgaacactttatcactttgttacaccattttttgtcctttttaattattgttttaaagtctgttttgtctgaaataagagtagcaacccctgttcttttttgttttttatttgcttggtagatctttccttatgcctttactttgagactatgagtgtcattgcatttgagatgggtctcctgatgatagcatacagttgggtcttgcttctttatccaatgggctactctgtcccttgtaagtggggcattaagcctgtttatattcaagttataatattgatatgtgaagatttgatcctgccatcatgttgctagctggttattccacaggcttgattgtatagttgcatatagtgtcagtggactatgtaattgtcttttctgtggtgtcaggaatttttttttttttttgagaccgcgttttgctcttgttgctcaggctggagtgcaaaggcgcgatctgagctcactacatactctacctcctgggttcaagcgattcttctgccttagcctcctgagtacctgggattacaaatgcatgccattacacctggctaattttgtatttttagtagagatgggatttcgctatgttggccaggctggtcttgaactcctggcctcaggtgatctgcccacctcggccttccaaagtgctgggattacaggcgtgagaaaccatgcctagccaggtaatggtcttttgttgccatgtttagcactctcttaaggactttttgcaaggcaagtctggtggtaataaattcccttaacatttgcttgtctgaaaaagattccgtttctccttcgcttatgaagcttagtttggctggatatgaaattcttgattggaatttttttctttaagaatgctgaatataccagcctggccaacatggtgaaaccccatctctactaaaaatacaaaaattagccaggcatgctaatgggcgcctgtaatcccagctattcgggaggctgaggcaggagaattgctttcacctgagaggcagaggttacagtgagctgagatcatatcattgcgctccagcctgggtgacaagggtgagactctgtctcaaaaaaaaaaaaaaaaaaaaaaaaagaatgctggctgagtataggtccccaatctcttttggcttataaggtttctgctgaaggttctgctgttatcctgatatcaccccctttgtatgtgacctgtcccttcgctctactgcttttaagattttttctttcatgttgaccttggagaatctgacgacaaggcgtctagaggatgggtgtcttgtatattatatctctggggttctctgaatttcttgaatttgtatgttgacctctgcagcaagattggggaaattttcaggaacgatattcataaatgagttttccaagttgcttgctctctctctttccttggggatgccagtgaattgtagatttggtatatttatataattccatatttcttggagattttgttcattaaagaatatctttttctttatctgactgagttgatttgaagaactggccttcaagttctaaaattgttttcagtttgatctgttctgctgttaatactgcccattgtattatgaaattcttgtagtgagtttttcagctctaggagatcagtttctcttcttttctttccttttttcttttctctcttctcttctcttcttttctctcagagtctcactcggttgcccaggctggagtgcagtggcaagatatcggctcactgcaagctccgcctcccgggttaatgccattctcctgcctcagcctcctgagtagctgggattacaggggcccgccaccatgccccccggctaatttttttgtatttttaatagagacggggtttcaccgtgttagccaggatggtttcgatctcctgacctcgtgatctacccaccttcggcctcccaaagtgctgggattacaggcgtgagccaccgcgcccgaccctgattctttcttaaaatggcaatttcatctttcagctcttgtgttattttattgatgccataagttccttagactgtgtttcaactttcccctgaatcttgatgatcttcattgacatctgtattctgaattccatgtctgtcatttcagtctggttatgaaccattgctggggagctagttcagtcatttggaggtaagaagacactcttgcttttagagttaccagagttcttgcattggttctttctcatctgtgtgtgtgaagttgttgtcctttgtatggagctttttacttttatattctttgatgccttttgtggtttgattgtggtattagttgtgcttagttaatttcattcgtttttggatgatttcaggggtccaagggttagctcagcactcctgggctgcatgctgtaccaggctgtaaccttgggaaattgggaccaggtctgaggcggttttctctagcccctagaggttaagtacctcctgggttggaaggaatgaggtgttcctggtccactggcaacaaaactgtgctggcaaaggcactttggcggggtggcagtgggtcagtgagggtccttgtgctcacatacgtgctggtggtggggtagtggcaagtcctgcacaggcatgcgtgctggtggtggggcagtgatggggtcagtgtgcatgcatacaccagtgagtcagtggctggaggctgcaggcaaaggcatgacagcaaagcagcaggtagaggctgccagtgagtgcatgctggtgggcgctcactgacagggacctgccttcaggagctctccagctgttaggcagggtctgccatcaaaatagcaatggctgtggctgtcaaaaaatgccttggctgggcagctgaggcagtgctgcaagtttgtgtagccaggcagggaatttggcataggccagcagacaagcgagtgcttggatcagattgttcccatcccacaagcaagagagccctgtgatgtccaggtctgtccatcaacaaaggcgaaagccacctagagatgtatgatatttgggggatgggcacccatgccatgctctgctgtagccattctcatgccaaaccctgtggactctgtgcaggctagaattctgtctctttcaactctccaggctgttctccctgccaccttaactgtccatgggggatgaggggtctcctgcagctaagattctggaggtctgtggtgtgagttggccactccatgaccatttaacttactccttccccaggagcctctccaggccaggaacaagttctggtgcttggcaaccctgtgcagggttaccagcttccttccctttcagcctggggtctgcattctccttccatcaactctcaatgccttctttctgaaaatttgttcagagtgtgccagtcttcttgatggtctggtccctcactgggagaaggtcttcttgtctgcgtctggtcggccattttgttttagtatttattaaataatgaaataataataatttgaaaaaattaaattattattatttaaaactctagatcttatttaaattttctatttaaccatgcctcagcagacattgtgatgcagagggagggggatgtatgaaggaattgcctcatttcccactcagcttcctttgatgctcaggtgagggactaatgctcattactactgcatggaggttaggcctcttctgataacactctggctgaaggtactttgttactgctccccttttggcctccactgacatcatggggtagtgatttcattactgcttcgcagtggtgaaagacttgacttcccactacctctcctcagacatggttctagtagatggggagagttattcctcattactgggtggtagttcatgcttcccactcagcatattcttttttttttttttttttttttttttttgaggtggagtctcgcttgttgcccaggctggagtgcagtggtgccatcttggctcactgcaacctctgcctcctaggttccagcaattctcctgcctcagcctcctgagtagctgagattaaaggcatgtgccacgacacctgactaatttttgtatttttagtagagacggcgttttgccatgtttgctaggctggtctgaaactcctgatttcaggtcatccacctgcttcagccttccaacgtgctgggattacgagtgtgagccactgcacctggtgcctattcagcatattctgacaccaatctagtagggaattgggccttcttacagcctggtaagcatggaagtcttttcagttgggatttattgtcttcctggatttgctgttttcccaagttgtcctcttattgattattttactagggagagcaggattttcttggagccttttaaaaaacttgcacttgttggcaggttgccaggttgctggcttcttccaagtccatgatatatgaagcaaaaaaaaaaaaaaaaaaaaaaaaaaaattgagagagctcactcttgtatcattccttttgtcctgcatttctgagcccacctgtcgtcttctctctaattttcagagtctttttatgtttgttttatttgtaatgcccaggtatttttttgtttgttttagccatatttagctggggaaaaaagaataagtaagtctgtcccatattggtctggagcgtttacatatttttgaagccgggttttgttttccagtgtttggctattgccaccaattttgtgcctttggtggatacaaaaattttgacctctatgtcttcatgtgcatcactcacaaaatcatggagggggccaataactggttccttctgtgtgtcactaaatgctttcataattttcattttgtgatttgacagaatttttgtttaatgtgctttctaagccctatagttctcttcagaattccatgttactctgtgtgctttctaatctgtattcataaaatggtaccattaatttctaagatttttttttacaatttttaatgttattcctttcatgctttcgcatgaacactatctgtattgccttcatttgctccacctcatttaattccctgttggcatcactatagttctttcccaacttttacctttgggttagtcgttttagcaatgttcagtttgctacattaaattcttttattcagttgacctttgtttatactctggcaaatgcccaagtttagactcacttcattttgtttctttttctgtgtttcctaattgctcctggaggaacacacggaacaaagtagattggtcccattaccacacactactaaaaattccttcctaacaattgaaattgattctgtaattcaatctcctgaaatgaattcaacttaaaagatgacttgaaaatatacttgatccttgttatttgcagattccatatttgcaaattcacctactcactaaaatttatttgtaacccccaaatcaatactcaaggcacttttatgatcattcacaagcatgcacagagtggcaaaatatcttattactcaatgagcatattcttacctgaggttgaaaaatgtgatactgtgcctttttgtttcagttctcattctgtaaacaagtgtcttttcttggtctacatagtgctacatttttcacatttttattatctttgctggcgattttgctgtttaaaatagtccccaactgtagtgccaaagtatagtgcaagaaggttgtgatgtgccatatggagaaaatatgtatatttggtaagctttgtttagttataagttttagcggtgtttactgtgagtttaatgttaatgaatcaacaatgtatattaaatagaacgtctttaaacagaaacacacacgaaatctgtttatgtcttgagcagttgacaaaaatgtgaccagagtctcctggaaaaccaaccctgtatttctcctaagaacaaggactcaacagtcattaattcagcatttgtggtgacttcacagaacacgactaccatgaataatgagaataacctgtattttatttgtcttcttgacggtcatggaatcattgatggtttagatattatgctagaccttcttttgtcctaatcatcatcatcctacttgcctccaactttcctgaaactgttgaaaacatcgtgcacttttacatttatgatcatccattattttctttattcaactatctcggtttctatagtctctatagtaatgtccttcctaaaaatttcagagaaacagatgtatgccctcttaatcttttattttataatttttattataaaaatttcaatggtatgcaaaaatagggaggataaaataatgaactttcatgtactcatcacctagttcaaaaatttacaactcatggccaaccttacgttatccgtacataccctgataaaatcccctcatcccctttccctaccaaaatatcaaatctattttgaagttaatcccagatgttatatactttcatctgaaaatgtccccattcaaaaatactattttgatggtgatattagaggtacacgctttacaaactttgtgagctacagaagagaagccaaatttgccctatgattacaatattctactttcttatctctgggaagacatggcacccatttttttgggggggagggatggagtttcatgcttgttacccaggctggagtgcagtggtgtgatctcggctcactgcaacctccaccttctggatttaagctattctctcgcctcagcctcctgagtagctgagattacaggcaaccgccaccacaccagactaatttttgtatttttagtagagacaaggtttcaccatgttggtgaaaaattccttcctagcttccaggctggtctcaagctcctgacctcaggagatctacctgcctcagcttcccaaggtgctgggattacaggtgtaagccatcttgcccagcctccatttaaaaaatgttcatgtctagcatccacagtttttaccacttgccttgctctttatattttaatatcacaaaaaccactaataacctcatatgtaaaaatttttccttgaatctcctactgtttctcatctcagtggtatttggcgaccttgcctttcttaagacatatcccttgtttgaatttcataattctgaaatttgctgatttctttcctcctcctccatctactcatttctggctgtatcctttgattaatctttctctctctctctcaatctggctatgctcaagattcagatctcagataaagtttttatctgctgtctatattctcactcaaagaagccatcttttctttgaactcagctatcaccttaatgagtgccaaacctgtgtctccagaattcaactcttgcccatatttagtcttacatttctacctacttcaaagtgatttctatttatatattttaagttcttaataggaaatgaaaatttgtatatgtgccatttgaaactcaacaggcatcatgaaatgttgcctgggtttttaagtttctcgctcatattattagggttcactattagagttttttttactcttatgtttcctccacatgtattcagttaagtcctagactattttcccactttaccatatcttttatgtttatttcttatgcccctattatttctgttaacaccctaatctattccctcatttctttgtgtcttaatacttccacggcttcctgtttggcttcttccaattttagaagtttctgaatacacttcctgttctgtttctcactaaaccattcactaaaaataacaggattaatgagacaaatagagatagagacagactggtccctcaaaagctatgcaactttataactgaagaattaacaaatataataattggtacctttaaaaatagcttgcacagtgtaggcaggcaaaacgcccaaggtctggtggcttactcagggcatgttaaaaatgcaaagaaaaataatgtggaaacacaggtttgctggtgctaaggcaatatacacagggaagtgtagtcctgagcagaagaggaaatgcaacctaaaactgatacaaagctaggatacatctctctggggagggagttttgggtacaggcactcaggcattttcttaaaacagtgccccaaatgtgtctgcctgtgtaatagctgagttgaaagggttttccttttcttctgaagtttataattccactcccattattctggctcccttgcctaaaaaaaagcatatctaaaccatcataatttccatcttctactgacataactctgccattcactaatcaaatgtgagctaattagtgctggtagaatagactctatatttttttctatttgatacttgctggacatcaccttacttttcagcttgtaatgctatttactgctatttatatactattatttatattatttactatttgtatactgctatctctttaaaataattatttattctcggactcatttattcctgtctcttatgctgattaaagctttgttttctcttgtatcttctatttctctatcctgattttctctgcctgcatatagacttgggattttattatcaaaattatttatttttgaatagcttcatatggcatatcttatttctataagcagattgcaggtttctagaggacaagatccatgtgtttataatactctttttatatctcctcctacatacgagggtatcagtaaatgcttattggttagttgatttaaaatcacaaatgtattatttcaaatgtactattatattagttaattttttaaatggacaaaagaaaattcacaaggaagttagcataacgtagggaaaaaagcatgggcttctgaattagatcgctctggattcaaattcggggtctgccactgattagcacgtgatctcaggcaaattacttaatgtttctgagtttcagttttcttagtaacccagaaaaaattaacctagttctatgttttttgtaaacaagaattacatgaattaatgagataatattttaatcaattaagaacttcatagagtgagtatgaatacttaatgggtggtcaataattagaagcgccaggatcttgaggaataatcagccagtacctcattattacaagccatataaagaatcaaaactctggagtttgcaggatataaataatgagaatttgtgattttatatatgcatttcctaagttctgccttttgctagactaagcactttacattcactgtcttacatcatcttcatagcactcatcacaggtaggtattattaggagcatttacagataaataaattaaaggtcttagccagcatggaaaggccaaacttgagatagaaaccctggtgtctgactctaatgtctgtttttttttgtttgtttgtttttttaaaatcagtaatagactcttcactcccttttttggggggttatgttacactaataaagagtatagacaaaataattagggagttattttgtcagatgtgtcacataagttaagagtacagttcttcaaagagatggaggcttcaatctcattgttttgaaggtttcaaggtatttcaaggtttcaaggtttcaatctcatcagttttcaaggtattggaggtcctcttttaggtggataactgacatagatggagaaaatcacttatgcatgcgaacacacggaatacttttgaaaattacccctttcattacattcttaagttagaaaaatagccaattcctctgtaatgaactgaattatgaattactaatttctgtcttctcctttagggtgactctggaggaccactggttagttcagatgctagagatatctggtaccttgctggaatagtgagctggggagatgaatgtgcgaaacccaacaagcctggtgtttatactagagttacggccttgcgggactggattacttcaaaaactggtatctaagagagaaaagcctcatggaacagataacatttttttttgttttttgggtgtggaggccatttttagagatacagaattggagaagacttgcaaaacagctagatttgactgatctcaataaactgtttgcttgatgcatgtattttcttcccagctctgttccgcacataagcatcctgcttctgccagatcaactctgtcatctgtgagcaatagttgaaactttatgtacatagagaaatagataatacaatattacattacagcctgtattcatttgttctctagaagttttgtcagaattttgacttgttgacataaatttgtaatgcatatatacaatttgaagcactccttttcttcagttcctcagctcctctcatttcagcaaatatccattttcaaggtgcagaacaaggagtgaaagaaaatataagaagaaaaaaatcccctacattttattggcacagaaaagtattaggtgtttttcttagtggaatattagaaatgatcatattcattatgaaaggtcaagcaaagacagcagaataccaatcacttcatcatttaggaagtatgggaactaagttaaggaaatccagaaagaagccaagatatatccttattttcatttccaaacaactactatgataaatgtgaagaagattctgtttttttgtgacctataataattatacaaacttcatgcaatgtacttgttctaagcaaattaaagcaaatatttatttaacattgttactgaggatgtcaacatataacaataaaatataaatcacccatttgcttgacattatgatatgataatccacaaagaaggggaagatgggaaaaatgttactagtcaatttattgtaaatttttttaaaatttgaggctaggatgaaaattaatttaataacaatcagcatgcttatgtactaaaataattgcgttgtggaatgggagggaacgaagagttcaaacaattgactggaaaggttttattcgtctaagactttcccaaacagcaaatccttgaagggaatgagatccaggtgttagtgtacagtctagtgatgcaactgaactggggctcagacctctattttgagatgattgtagatatttttcttcccctgctgctgtgtttacagttcatacatggttaatggtcctgttagactcctcttcgctgagatggaaagataccatagagaaaatatcctggaagctgcctcactgctgcatctagtgtgacactgaatggctaactgcctggataacaaaactgaagagtaaaagcatgatattggccaccttcatgatttttagttttggtaaattattactgagctgttagagacacagctttcaagtaatccagaccgtaatgaagttaggactggtaccatgatgtacggcatgttaatggtgagatttcaccaagtctgtcctcattgcatatagctactcatataagttctatattgtacaataattaccctgaaaaccagtattgccacgaaaaatttaagtttattgatctgaataacactggagtatgaactgataacatttaggcacttggcaaaaatatgaaaactgacatgaattgatagtgctaaatattttgcataagctatttttgtttcatttagcaaaatgctctgggaaaaaacaaaattgaggaaaaccttgaattttaagcaaggatataagtacctttaaaactactctcagtgttctgttaaaaatggattcctcttgtttcagtgtattctgtagttgggcctctaggtggcacccacaagctgtaggaagctatggggaagcctgacatcaagaaggatgtctagatctgtaagtaataatgagaactgtacctgaaattagagtctcgtgaaaccaaaagaatacagtttttctttgcaaatggcgtttaaaaattaattcgtgttgatttacatcattattcgtatttttcaaatttctggacatttgattccaaactaaaataaaatttatgttgcatgatttgaggaactccctctgcaaaagcacctggagcaatttaaattaagaagaaattttaaaagcttaattttgcaatgacatcttattcctaagagaaatacttttgatatttccttctacaaaggatttgagaaatagaagtttgggtcaaagtgaaaatatgagcgatagttcaaactttatgtacatagagaaataggtaatacatttctaaaatggtaacttcttttgaaaagtaattaccaaagggttttatctgcatgtctgtgttaactgtttcattggagatagttaagaagatgtgacgataatatttattacttttttcaagagggcaggcagttcctcttctatatcttcgatctctcttcctacagcactagtaaagtactctgtatataacagtccttcaataaatgttgttgaatgactcttttatttttacattatgcagaaaacatagctttattattatttacacattgatttttaaaattaatcccagattttacactgagtgaattaagccggttactatttatctaagcctataatctcacccgtaagatagagatgatatttgctcaaatgattgttgtggaaataaaactgtgaatgtttaaaaagtgcttagcacagttcttggaacattagtaggtgttcaagagaccatagtaataataactgttgctataatgaaactacactcttgttttaaaaaatatggtatttgattataacaggctgaataccttttttttttgaaatgacaagataattagaccaacaaaatgtgctagttaaaaaaatttctgattctacaaaaagttttactgggataattccgaaacatatttatcaaagtggtctgtcaatgtgagggttcattctaacttttgacttcaattttaaaaaatgataaactttattaaccaccgagtggctggattatatcaagatctatggtgtagttcaaatgtcgcctcttccctgaagcctttttttacttcctcaagtggatgtactatacgtttcttctgaacttccttaccattaattttttttattttcagataatcattgattcagatacggttaagatataactgtaagatataattcacagagattctgtgtaccctttactcagtttacctcaatagtaagatcttgcttaggtgtagtataatattacaatgaagaagttgacattgagacaatccattaactttattaggatgcaatcaattatatatgtgtgtgtaggtgtgtgtgtaattagttctatgtaatttaattacatatgtagattcatgtgattaccaagatacagatagtttgttcacaaggctacatcacgctaccgacagccatccagctccctccctaggcctgtgtctagtctctaatccctggcaaccactaatctgctctccatctttataatttttattgtttcaagaatggtatataaatatattatacaataagtaactttttcaggttggctttttcgctcagtataattttcttgagatctgtccaagttgttgtgtgtgtcagtagttaattctttttttattactgagtagtattacatgatagggctgtacctcagtttgttaactgtatacccactgaagggcatttggattgttctcaggttttggctattacaaataaagctgctatgaagatttgtgtgtaagcttttgtgtggacataagttttatttttctgagatttatggcctagagtatgctgggtcatacggtaagtacatgtttagatttttaagaaacggccatattcttttcacatggctccttactacttgtaaaactctctgtacttagaatatctacctgtgtatttcagatgtgcagatagatgtgatttcaacaactagactgtaaactccatgagggtggggacagtaactggttcatttttatatccttcacagttcacaggaaactataatattgtttatggcagttgttctataaagatttattaaataaaaataaagagtaataaaagcaaacaaataaatatacatgaaataaaaaagaagaaatggctttgggtagaaaagaatgaacagtatttccttcatgaaggtattactgctcaatttctgtaattctgcatggactctaccatggcacttccatgtatcttatgttggttgatataaagtctgtttttcacctttccacagggtacacaatcaaacatagactaaagacatggttgatatggagaatctctctttatatctgaatttagtttctgatacatgttatatttaagagttttctgacacatctgtatcagcttctactgtatttgtggaatggattccagtttaggagcacaatcaataaatatttgttgctcttactttttataactatgattctataatttgtcctaatgtaatttttattatataactcaaggtggagtgaaagacagagacctgtgaaatgtaatcagaagttctctcttaattgtccctaacacaataatcagtacctctttggcgtagatgtagtcagcttaaattttacaatcacagtactcactgccttgcatatacccctcacctgcttgttctcttgctccaccactctgtgacacttgctttttactatgatcctggtaaaatttaactctccacttactgtttttaaaaactaattaatttcccccaattttattaaagtataattggctaataaaaattgtatatagttacagtgtaaaatttgatgttttgatatatgtatacattgtgaaattatttaatcaagctaattaatatattcattacctcaatacttactattttttaaaagaacatttaatatctattcagcaatatctacttttaacaatttaaaaatactcaatacattattattaactgtagtctccatgctgtaaataggcctccagaacttatttcttctatataactgaaactttgtaccttttaatcaatatcttctcatttctaccacactccagcctctagcaaccaccattttactctctgcttctattagttcagctttcttagattccacatataagtgagatcatgtagtaatcagcactctgtgtttggcttatttcacttaacataatatcctccagattcatctatgttgtcacaaatgacacgattcccttcgtttttaaagctgtatcatattccaatgtgtgtatttctttattcttccaccaatggacatgtaggttgattctatattttggctattgtgaataatgctacaataaacatgagaatgcaagtatttctgtaccaaaagtgaaaaacagaatggttgtatggtacttaaagtatggtttctactgaatatttcaattaatcactgctgagataaccaaaatagtgtgtaaaaaacaagcaaatcagcaaaaccaaaattgcactttttcaaaatgtcagataaatgactaatcttttaactagactgaactcccataaaggagatgattcacattttaataataaagtcagatataatagtaaagacattattaccaatcatacagaaataaaagaattataattgtatattaggagcactggtatgtcaacaaattataataacttagatgaaatgaacaaatctctaaaagacacagtcatacagactcaagagttctaacacaattccattatgttcaaaggacacacttcgtatgatttcagtacttttattgagagacacggcctagcaatggcctatcttggaaaatgttaatgtacttgagaatattatatacagtcatgcattgcttaacaacagggatatatgaactgcattgttacatgattttgttgtgtgaacatcatacagtgtacttacataaatctacagggtgtagcctactacacacctaggctgtatggcataatctattgctcctaacttacaacctgtacagcatattactatactgaatactacagggaattgtaacacagtgggaagcatttgtgtatttaaacataactatacgtagaaaagttactgtacaaatacaatcatctaaaaaattaaaaaatggtatacctgttaaaattcttatcatgaatggagttttcagggctagaagttgctctgggtgagtcagtgagtgagtggtgaatgaatgtgaaggcataggacattattatacactaccgtagactttataaacaccatgcacttaggctacactaaatttgtaaacaattttccctcttcaatgaaaaattaactttagcttactgtaacccttttaatttataaactttaaatttcttttactttttgactcttttataatagcacttagcttaaaaacaaacatatttttcagccatacaaaaatattttttctttatacccttattctataagctttttaaaatattttaataatttattattttttacctttaaactttttggttaaaaactaagagcccaccacagctcagcaaggccactgtggccagactgactctctagattccctcctctctgggcagaacatctctgaaaaaaaggcagcagccccagtcagggacttatagataaaacccccacctcctgggacagagcagctgggggaaggggtggttgtgggcacagcttcagcagacttaaatgttcctacctggcagctctgaagacagcagtggatctcccagcacagcgttcaagctctgataagggacagcctgcctcctcaagtgggtcactgacccccgtgtatcctgactgggagacacctcccagtagaggccgacagacacctcatacaggagagctctggctgacatctggtgggtgctcctctgggacaaagcttccagaggaaggaacaagcagcaatttttgctgttctgtagcctccgctagtgatagccaggcaaacaggttctggagtggacctccagcaaactccagcagacctgcagcagagggccctgaatgttagagggaaaactaacaaacagaaaggaatagtatcgacatcaacaaaaaggatgtccactcagagaccccatcggaaagtcactgacttcaaagaccaaaggtagataaatccacgaagatggggagaaacaagtgcaaaaaggctgaaaatccaaaaaccagaatgcctcctctcctccaaaggatcacaactcctcaccagcaagggaacaaaatgggatggagaatgagtttgatgaattgacagaagtaggcttcagaaggtgggtaataacaaactcctccgagctaaaggagcatgttctaacccaatgcaaggaagctaagaaccttgaaaaaaggttagatgaattgctaactagaataaacagtttagagaagagcataaatgacctgatagagctgaaaaacacagcaggagaacttcatgaagcatacgcaagtatcaatagctgaaccaatcaagcagaagaaaggatatcagagattgaagatcaactcaatgaaataaagcaagaagacaagattagagcaaaaagagtgaaaagaaaagaacaaagcatccaagaaatataggactatgtgaaaagaccaaatctatgtgtgattggtgtacctgaaagtgatggagagaatggaaccaagttggaaaacactcttcaggatattatccaggagaactttcccaacctagcaaggcaggccaacattcaaattcaggaaatacagagatcaccacaaagatattcctggagaagagcaaccccaagacacataattgtcagattcaccaaggttgaagtgaaggaaaaaaatgttaagggcagccagagagaaacgttgggttacccacaaagggaagccaatcagactaacagcagatctctctgcagaaaccctacaagccagaagagagtgggggccaatattcaacattcttaaaaaaattttcaacccagaatttcatatccagacaaactaagtttcctaagcgaaggagaaataaaatcctttacagaaaaggaaatactgagagatttttgtcaccaccagtcctgccctacaggagctcctgcagtagtttctgctgccttttgttcagctatgacctgccaccagaggtggagtctacagaggtaggcagggctccttgagctgcagtgggctccacccagttcaagcttcctggctgctttgtttacctactcaagcctcagcaatggcgaatgcccctcccacagccagtctgccaccttgcagttctatctcagactgctgtgctagcagtgagcaaggctctgtgggcatgggacccgctgagccagggccgggatataatctcctggtgtgctgtttgctgagaccattggaaaaggtgggagtgtcccaattttcctggtagagtctgtcatggcttcccctggctaggaaatggaaatcccccaaccccttgcacttccagggtgaggtgatgccccaccctgcttcagcttgccttctgtgggctgcacccactgcccaaccagtcccagtaggatgaaccaggtacctcagttgaaaatgcagaaatcacccatcttctgcattgatcatgctgggagctgcagaccagagctgttcctatttggccatcttggttcttcactatagacatgttacaaaggaagatatacaagcagtcaacaagcatatgaacaaaaagatcaatatcactgatcattagggaaatgcaaattgaaaccacagtgagataccactgatcattagataaatgcaaatcaaaaccacagtgagatactatttcacacaagttagagtggctataattagtcaaaaaatagcagatactggtgaggttgcagagcaaagggaacacttatacactgttggtgggagcgtaaattagttcaaccattgtggaaagaggtgtggtgattactcaaaaagctaaaagcagaactaccatttgacccagcagtcctgttactggatatatgcccaaaggaatatatatcattctaccataaagacacatgtacatttatgttcattgcagcactgttcacaatagcaaagacatggaatcaacctaaatgcccatcaatggtagactggataaagaatatgtggtacatatacaccatgggatgctatgcagccataaaaaagaatgagatcatgtcctttgcaggaacatggatggaactggagaccatcatccttagcaaactaacacaggaacagaaaaccaaatgctgcatgtactcacttatgagggggagctaactgatgagaacacatggatgcaaagagacaacagacactggggtctacttgagggtggagggttggggagaagaataggatcagaaaaaataactattgggtcctaggctttgtacctgggtgatgaaatagtctgcacaacaaactcccatgacaggagatcacctatattagaagcctgcacttttacccctgaacctaaactataagtttttttttaaaaaaaatcttaagaaagaaacataaagtcaaacgttttgtgaatattatgtcaaaattatgtgcttatcattttgctgctgttccttttttaaaaatgctttttttatctctctgtaaaataatggtgttccctttctaatgcaaacatactttcagatcctaatcatcggggtaaacattctttttaaaactattgtttacaaaagtaaaaatctgactttgtccatgcagatcatctattgacaagtatttttcaacaacataattttaaccttatgacatcagttttaatagcagtcattacactattattccaggtgattctgggacacctgagtactctgtgtaattgaagttatctgtagccacatttaatatgacatgttcaatgtttggtctcacaagctcactgcttagagtcttcttcatccacccaatattgaagtaatgaaatggctgttaatagattcatcactgatctcattctgcgacatctttatcagaataatataaaatcaatgtaagaaatttggtgaaattatgaaaatttaggaaaaaataaatttcatttataaaatctgtgtgctttcattatggttttattctatttatataactcaaagtacatatattatgtttacataaaaattttttatctcattgcatgtatcttttcttctgacacaaaaattgtgatatttttctgttcatcattttgttccgtagtattcaacaatacctgtactatggctgacagtgtaatttaacattttttgataaaacaattgtaatgacatggtacacacattgtatacattttaaatcatttctcaatgtaaaatatttgaattgtctccagtgtttattttatgaatgtctgccacaaatattgaatctgaccatcgtgatttaggtgttctctgtatagtttcatatgagtatattatgaagccaatgtctatatgcatttttataatacttaatacttttccccaagtgtctgattcttttaaaatatgcaatcattatctgagaatctaatacataatggaaaagcaagaaaatttgtgacaaaaattattttatgtaagaaagaagtagaggacaggctgcacaactattgacctggattcgaacctaccttctgcaaatgaataacaacagctagtattagtatttatcactattgttctaatagtcattcttgcccttgtcttccttctccacctactctcttcccccttctaatggcaccatcactttcctctaatgtgaatgggaaaattttttgagaataaggttagagtgcatagaattttcattggtcttacctctgcctttgtcctttgggaaattaccacatagagcctatgcaattttcattcaacatagacattgagttttaactcaagtaagatttcagttttctgttgctgcttataagaaggtagacaaaaagatctcttaaggcttatataataaagtagtgaggaatgcttgctttctgcttatgtctcaaaagaataacattaaagtaaaatatatgaggttcttttgtttcttcgtaaggaagatcatcctatatcctgacagaattcttttgtaaatctcagtgtagttttcagatgcaagtggtagacattatttggatcttattatacatgcattgttcatttttttttggtgcttctctgtcaggcagctgtgatgatgagtcccaagtttcccagagatttttactgaggtgtcctataggcgtggcataaggcagaaaacattaaaaggttaaactgacccttttatgctctaagatataaacctctgtgatctcactgacgaaagttttaaatgctagagtgaaagcaagtaaacattggctttggctgagaatattctggtggcacacatttatgtcgttgatgaatagtgtaccttgaaaagccttaacccttacatcgttagcatttcatcttgttcatctgactgcccaaaaatctatatttaaacaagtccacaggggatctgttctctaggactttgctggagaaccttgatgtgttggaaaactgttcctattaatagaaaaattatatctcgagtggctggcatatgttaactaatggatactattaatagtaataacaaaaataaaaaatcattacaatattactactatttgaatcactatgtacgagagacattataagtgttttatctgtattaagtatattttcaacacaacacaataggaagaaattgccattattatagaagtaggcataattatctctatcaacattctagtccacttttccattatctgttgcataaactcatgcaaaatcttctaaatgatctacgcttttcacaatctggcctttttgtgatgtaatccattgacaacattgagagctttttaaagaaagggaatctgatcacatctctccatttcttaactctgtgcagtagctccccattgcccttaatagacacttcgatctccttataattatattgcttccacttacctctctagcaacatctgctactttactcagctttttcctgcatactaattagaaatcttaggaactgcctttacttcactacctgcttttctttttttgttttcctctccccctcttcttttcacctattcctgcacattactgaggactcactttaccaatgactttgagatctcttctagatgtttgcttagcattgtgaccttataacacttttagacttttcctttttacttgcttatagtctatctttcaaagtacaacgtaaggcatgagggagcagaaagtgcctacatttcttctctgaaaatcgagcacttatccatggtttatgctgatcacttcataaacattctttgaaggaatgacttatactttttttttactttgcacaatgaaggctttcattgaatcaaccctgttttcagagtctctttagtatccctctttgatatttaatgacactaaagtttacacagttgtgatgatatagaaacatatgagtttctaatggtaggtcactttactcgacctcccatattttctcttactgtgagtcaaacactctgaataaaaacatatctggccattccttctgaaatgcaaagcaaacaaatcaaacaggagtaaatttaccttaggcagggttttggctggtttacagtggagttcccccacaaaatcgacatttggtaagggtgggcaaagaaattcaaaatcccagtacgtttgaatgagccacacttcagctttccccattatctgaaataatgtacattaataaaataaatgtatacatatctttttatatataagcataacaattttcatatattgcatgttacttatatataaggaaagcaaagtgttcagataattaagaggaaattacatatttaatgtaacataagtatattcacaatcacaaatagttattgaaataagccactatggacttaaatatgcatttgtttcctctctaaagttgcagtagtaaccaatatagatttaaacagctctttgagctccacgattaattcatcttactatacttataaaaacagctttctacaaagcacaaaatctagtttccacaatttatcaagtcagtcccttgatccttggttctccaagtgaactgtgagttttctgagagtatggctgaaatccttgaacatactactgcttctagttcatgttaagattttaatgatattagttgtaaaatacatacatttaaaaatgatagctagtatatattcagaatttattgaaacagagatatgtgctcccccttaacttggcccatattttccctaataaagagaagtagttcaataaaatatagattaaaagcttgaatgttcactttcaacaaggtttcagttcacaaagcaaataatttccaagttgttagtgaactatgaacaaacactagaaacctcaaattttaggtttctgtttctgaaatagagccagtatacctctcaactgtgaaggaatccttctgtttatagagaaaaatattttaatacctaaataagaaaagtgaggtacacaaagagaaacaattttctcaatgctgcattaatagttatgctagaaatatgtgtagctcctcatctaaatgtctgccttcatcaagttgtttattgatatatgtattgccttttttaaagatgaaaaaagtatagtaaaatacttatatagttgcttaaagaaatcataagtgctttactttgtagttttttttttttaattcctgtagtgtcctataggagcgatggccaaagggttctagctgagcctataatatcaacatttctataatatttgtgagattgatagatcatcttacatttgccattcatcatttcatttaaacaacactatcttcttacattatatttatatacgctcaccttcaaaggcaaaaggaaagttagaacttattaaccattgattagaaacatgacttacctagaacttcactgtaaaacttctcccacttctcgtatcaaacatttgaaaccaaaagtcaaaataaagcacatgtattaaatttttaatcctctccacgaatgtcattttaccacttaattcagacagaacagcaggtatgcgggaagtggggaatagaagtcctccactatacttctcaagtgtgtagccaggagactgtcaacaaaggacatgtatttaacatgcctttaacatgctcagctagcagttcaccacaggcaccaagggcatctgcaagaacgacatcaaacattgactcttgtagttttgtcgtaattttcttgttcaaaactacatctttacagagattattaacacagtctgtagattcccaaaagagttcttgtgcttgtgagaaatatgaccaaaatgcatctttctgaagatcgtatatccatctattgatcagtttcacaacaagaccctcaaaattatttttaattagagatgttggataaacctcaaatctaatagcagatgatttactagggtgaataataatggaagccaaagatgacagcacagtcatcttatggcctctccaaacaagttcatccaggattgtctttatattcatccaatggctgtattctgtgggccacactagcacctttccacaactcccagaactaaagtgacaactgagttgtatcaggagaatatttgacatcgatttcatagttctcctggtgcaatgcaatgcttcttttcaaatcgctgtttctttctgtttttctcctacttatatctgaagataaatcaatcaagtgaaagtataactgctacaattcaaagtagtagttaccatataatttctaaattaccataggaattgtctgttaccatataatttctaaattaccataggaatttccagattgtttttcacagtggatgcttcaatttccattctcaccagcaatgtataagaattttaatttcttcccaaccttgccaacacttgggattatatttcgtttgattatagccagtgtgaatgaagtgatatctggttatgctttacctttctttgatatgaaatcatgttgagcatgttttgcctaattttggttgaattatttgtcttcttatggacttgtgtttttaatatctttctgatataagaaccttatcacatatatgatttccttgttttttttttattctttgggctgtccttttactttcttaacggtgttcattgaagcacaaaagtattgattttgatgaagtccaactaatcaattttaatttggttgcttttatttttgattttatatctcacaaaccatttccaagttacaaaaattagtacctgttatttattattagagttttatagttctagtgcttacatttaagtttttgatcacctttgaattagcttttgtaagtgatttgaggtagagggtcccaactcaattattttgtatatggataatcattattcccacttatatttgttgaataatctattctttcccccttaaatagttttgaaacttttgtcaaaaactttaaatgcatgggtgtatttctatattctaaaatccattccattgatctacatgtctatctgtaggcctgtatcacactctcttgattattgtatatttgtatttgtctttaaaagcaggaaatgtaagttttccagctcatttttattttaaattgtttcagttttttaaaaaatttttttcttcttgctttttttctttaagaggtagaggtgttactatattgcccagactagattcaaatttctgggctcaagcaatcctcccaacacagcctcttgagtagctggatttacagatgtgtttcactacacctagcttcttttggctattagtatgtctcttgaatatgtataaatttcagaatcagcttgtctgtttatgcaaagaagtgatctgggattttgatagggattgcattgatttggtatatgaatttggggagtagagtatggtaattatcacaatattaggtctttcaataaatgaagatgtgatgcctttctatttatttagatgttcttatttccacagcgttttgtagattttgttacagtggctagctagtcagacacaaacagggcagaagacggctcccacaccctaccaggaaagtcagatgaccatcagttaatggtcaggcagttgtcacactgtctcgctaaaataataattggttgcagccagccagagaaaggcagctttcctataaatagaaaaaatcaaatctggtaatcagcagcttcctgataagatctcaggagttgggtgagtgggctcacgcatgcacattaagaggccaaatggtggagtaagacattccggtggcaccagaaaagggaagaatgcctcaggggagcattcatatgactccagtaaacatactgtgcatactcatctcctaagtgctagcaggccatcacacataccagcaggtcaccctaaggaaagaatcaaggaaaatggaagcaggatcctggaagtatgccaacatataaaaccctaagtcaaaggtcaaacactgcactttaccttcaaaatggccacttggatataccccaagtgtactttcctttctttcctgctataaacctttttaataaattttcacttttgttctgaaacttgtcccggtctctttttttgccttgtgcccctcaatcaaattctttcttctgaggaggcaagaattcaggttgctgcagaaccacaaaaatttgctgcagtaaccaccactagtaataatttcacagtgagagttgtacaattttttgttaaacttattactaagaattatattttttcatggtattataagggtgattgtttaatcttcattttagtttaaatttccattgcaattttgtagattttttgttttcttatcttggatcccaaaatcttgttttattggtttacttgaatattttttagtggatttgtaaaaatttcctattacaagatcattatatatgccaatagagatagtttaacttctttctttctaatgtggattccttttatttcattttctttcttatttgttgactgaaatttctactgcaatattgagtggaagtgagaagagtcaatttagtgtgatgttagctgtgtattttttttttttttttttttttgagacggagtctcgctctgtcgcccaggccggactgcggactgcagtggcgcaatctcggcttccgcttcccgggttcacgccattttcctgcctcagcctcccgagtagcagctgtgtatttttttatagatactattgatcagttttaagatgttctcctttacttctagtttaagtgttcttatgatgaagagtattgaatttcattaaataagtttttctgcagttattgaagtgattatgcagttttttcctttattctaatgatatgatatactagttggctttttcagatgttaacataactttgcattcctggaataaaattcatttgtttatggcatttaagcttttcgtatgttcctgaattttctttgctagtgcgaaaggaaagtaaaaatcttgagacattaaactcactatgtcaaagagaaaagttaatcttgggaaacaaaccatgtaaaactggctcccattttgttcctaaacagataaatgcaaaaatagaaggccacatacctctccagagggcctccttcccaatttactcacaaggaaaatcacaaggtcctaaaacagagttctcttgacttttaccctgagagtataaattaacattttatatttgcaggtatataaaagacaggacttgaagccattgtgtggtttttagcataagggcttactgaatggtggttatgttttctcctcttttattttttggaggattaattattttaaatatttgatagaagtatagagctttgatattttctactctaccatttccagttattaccccactatttttttctaaataatatttcactggaagccatcagacactggcttttcttttatgggagactttttccttacagcttcaatcttgttacttgttattagtttgttcaggttttttatttcttcatgggtctatcttggttggttgtatgtgtccaggaatttattaatatcatctaggttttccaatttgttggtatatagttgttcataatattctgtaataatttgtgtttctgtaatctcagttttttgtctcctctttcacttctgattttatttagtgggtctgttctcactttttccaacttagtctagctaacagtttgttgattttgtttacttttacagagtttaccttattgtctgtggctgcttttgtactacagtggaagagttgagtaggaacaagagtctaaagggtttgcaaattccaaaaatatttaccatctgaggctttatagaacctattctgatctctgcaggttcattttttcctttaacctttctatatattcaatatatatttctatatatttctgtattactatatattcaatatattctatatattcaatgcaattttaataaaatagtatagatttttagtgagtcagatgatttatgtttaattatgttaataatgagttaataaattaatttgtatttccattttatttagaataggtgagtttgtttgttatgtggaatggtgcttctgttttaccttttttttgagaaatctctaaactgctttccacagtaattcaactaatttgcaatccaccaacagtatataagcatttccttttctctggatcctcactagcatgtggtattattattaatttatactttttagtaatagccattatgactagtgtgagatggtctcattgtggttttgatttgcatttctatgatgattagtgatgttgagcatttttgtcacgtttgttggttccttgtatgtcttcttttgagaagtacctgttcacatcttttgcccggtttttcacggggttacttgatttttgcttgttgaattattcaagtttcttatagattctagatattagacctttaacagatgtgtagtttgctaatatttcttcagtttacatctcacttgtgaattttgagttttgttgcaattgttattaaggacttagttataaattctttcccaaggctgatgtctagaatggtatttcctagattttcttcaataagtcttatagctttaggtcttatatttaaacatttaattcatcttgggttaatttttgcttggtgaaaagtagagatccagtttcattctttttcttatggctagcaagctatcccaccatcatttattgaatagggagtccttttctccattgcttatttttgttgactcagtgatagatgactataggtctgttgctgtatttctgggctctgtattctgtttcattgatttatgtgtctgtttttgtaacagaaccatgctgttttggtgtctgcagccttataacatagtttgaagttgggtaatgtgatgcctctggctttgttctctttgctgaggcattcttcagctatttggactaatttttggttttatggaaatttttgaatatttttttctaattctgtgaataatgacattggcattttaataggaatagcatttaatgtgtggatggctttggttaggatggttattttaatgatattgattcttccaaccctgagcataaaatgctctaccatttgtttgagtcatctatgatttatttcagcagtgctttgtagttcttgtagaaaacttttgtctccttggttagatgtatttttaagtatattttgtttgtgtgtgtggtataaatgtgattgtgttcttgatttgactcttagcctgaatttttattggtgtatagaaatggtattgatttttgtacatggattttgtatcttgaaacattactgaagtcatttttcagttctagcaggctttaggcagtctttaggattttctaggtatagaatcatatcatcaccaaagaacaataccttcaattcttttcctatttggatgccttttatagctttctcttgcttaggtgctcaattaatacattattgaaatagaaagtgctgtcattttaatcatttatatttgaaatataaaattttaaaaatttatatttgaaattttaatcatttatatttgaaacataaaattttaaaattttaaaattttaaaagatttggactatgttaagtccaaattcattgcagaaatgtacttatccatttaataataataatagttatagcaaattgaattttgctatatacagcaattacatacagcaactcttttagtctcagcaatgctattaagtaggtagtgacattgcttcatctacatttcactgaaggagaatgtgaggcatagacctgataagtaatttgcttaactatacatgattctgtaatggttttgcaaagatgatataggttatctggattcagagtgcaagctcttacccaccatcctatgctgactactctttctgggttacaggtagttacaaaatgtaatatagattcactttttttgtaggtatatattaattttaatattattacaggagtataactcaaatatgtaaaaatatttttctggttgtctatcactgcttaaccaactgctctgaaatgaaggtgcttagaacagcaacattttatcatcatctgttttaattctaggttgttggccaggctcaattaggtgtttatggcacagcatttctcagttggttactgtcctaaggtagcttgggctaatcatctgaaggttaatcactcacatatctggtgattagtattaaaagtctcaagctactgcagtgctgggccaattgtgacttattaggcatacatatgtatttctacaccaaatggtatatttctcctggggactgtggatatagcacagggctccaaagcgagtggagagacagagaaaaaggaaaaaagaatgacagaaacacagagaaaaggacagaaggacagacagagaaaatgtattaacaatttttttgagctttggaagttaagctcctcacttccactatattctcttttttgagacagccacaaaatttgctaaatttcacaggaagggtatatgacttgatgagaggattgccaatgcatttgtaatcacatctcaaaattactgcaaatataaccttaaaaattagaagaaatcactaaactactgtagaattcataaaatgttgacataagacattaaaattttaaaaatttgtttgctaaaattttagccataattaaaaattttaattaacattctaatatatttattaataaatatttaaaatatcaagtaggtgtccaaaaacaggctgtaaatttatcagatagagagcaccggattgctggtcaatttaagttttctaaatggcactaatggattgataatattatattaaaacccaagaacatgctatctcaaatcaatgtttatttcactaattaatttttaaaactatataattaatatataaaaacaaatttgtgaaaggttagtgaatgaagtatatagaatcaaaattaaaagtagaatcctctatgtttatacagatttacagattcttaattttatttcaaagaagaatatcatacttttttttctggaactttttttcatttagcaatgtgatgtggagagcattccatgatattgtctgtaatatgcctgttctctgtaattgctgcataccttctactttttgtggtaggtatgtatgttcattgactgatagccaggcaagtgatggagggaacatcctgtacatacatgcactcaggtgcaagtatatctggatggcagatgactagatgtagaattgcagagtcaaactgtatgtttaattttttttgtaagagttgtttcactttatactctctcacaaactcttttctcagattcttatgtttgatcaatctcctgtgggaaaataattcgttgactttttatggctacatagtaatccatggtgtatacatactgcactttccttattcagtctaccattgatggacatttaggttgatttcatgtctttgctattgtgaatagtgttgcaatcaacatatacatgcatgtgtctttataatagaatgattatattcctttgggtatatacccagcaatggcattgctgggtcaaatggtatttctgtcattaggtcttggaacagacaaccaaatgctgcatgttctcacttacaagtggaagctaaatgatgagaacacatggccacacaggaagctaagtgatgagagcacatggaacacatgaacaacacacactggggcctcttggagggtagaaggtgggaggggggagaggatcaggaaaaataattagtgggtactaggcttaatacctgggtgttgacacatatttacctatgtaacaaacttgcacatgtacccctgagcttaaaataaaagttaaaataaattcattgacttaaggttattgacttactaaattataatgtccaactttctagtacaagtagccatctttttgatgtgattggccatttttacttctgtgaattgtcaattcatatccttcatctattttcatattggtctgtttgtctttttggttggtgatatataatagctctcactatacaagagataccagtcctttatctatgtgttgcaggataagcttgatgtaaattactttaggtttgtatgcatgatttagcaatattatctactatgacactatattcattcaatttttcttaaaaatgtttcatttatctagatacattttataaaaatgttgctgcaatctcttccaataattcccttagcatcaaaattttaatttatttttagaatacattcatgccataggtcatagagtggttattgtgagacttggatgatggtcttcttaccaataaagacacataggtttgtgttaacccatactactttgatcataaagtgtttccttgatgtgtagcttttaagagggccttgagaattcctgagattttattatttgccaatttttggtaatttttgtggtcttttaattgttactgattatgattagttgcaatatgcttacattttaaaaaatcattatcctatttttggtcatgctaaatgacttatgttttcatattagtgttatgggatgaatagagttacaggcttctgaggaaagagagaaacatgagacatccttatataaaatagggttatatagaataattatcatttttaactgtcttctacaaacacattcagtttcacaaacatctgtaaggcagctcaataattctgtgccttgttttggaagaagtgaacacatatatacatgtacatttgtgataatcaaaatcagtaagtccccttaaagtgctggttttatattatcacaacctacaattcagacattttatccaatattaaagtttaaaaatgaccgtgaaagcaaccagttcacactttagaaaagttcatggggaaaagagaattagcttgtgaacaaaggttttcccaaatagttaaattttgtagtatttgtcaggtaggagtcattctatctctaatttgttgttctccaactccaagtctctgagtcccattattttgctcttcaggccctgaatttggcataaagtgtagtagaggcggacagtgtcgtctcctgtgcatcactgttgctttgcgaagaaattctcaatgtggtcagctgctgctgctacagaagtcgattttctttaaacactgccaagaacatctgacttacatagtatattttgatttgatatttattcaaactgagcctgctttttttctttttacaaactctctaaaactgctaaaagtcttcactttataaactatgtaattaccatgatctttatactgttggtaaagcaatggttcactttccccatgtctttcacctcagttcttttctcccctgtgtgaattgtatccattttgttcaaagtgattttactgaataccaggagttatcacctctcaagtgttattggcaatgagattgtttttgccagttatcagtgaattattaaattccaaagtcccttgttgagggtctgctttttagtgccacttgcccaagctgccatagtctatttttctcagaaagcaaagcctgagataagaattagtgtgcaataacttaatttgagaaatgttcttagggtacaggagtaggggacaggaaagggtgaaacaagaagggagaaaagtcagtacaagaatgtgttaccaaactaatcatcaccataactgttgggactaaagctcatgcggacccagtaggaagttgtgtggatgtaaagcgtgatcattaaccatcactttctattgctcacactgccaggttatgcatatgtgagtgagtgctagctgagtttcttcgagggttccatgaagagatgttaaagaagtctggtgcagaaaatgagagacctgtcctatcagaagacgacttcacaaagctccttgacacagcaaaggctagagaaaaaaaaattagctgaaaaaatatggggtgcaacctaatttgatcaaatgtattagagctttcttttttcttttgtttcattttcacagtatattacttttcatatgattaaatactgtaaattttctcaggtttctgataaagttatgcctgtgatacaggagctagaaagaaattatttaggcagatagtgagggtgaaagtccttggtaaggttttgttttaataaaaagcagccccccaaatcatttccttgctaacaaaaagcagccagaaaaatcaagcttcaaacctagataaacaagctaaagcttgcataggtaaatgctggcaactgtgccagtaattcctcaaggatctagaactagaaataccatttgacccagcaatcccattacttggtacacgcccaaaggattctaaatcattctattataaagacacatgcacacgtatgtttattgcagcactattcgcagtagcaaagacttggaaccaacccaaatatccatcaatgttagactggataaagaaaatgtggcacatatacaccatggaatactacacagccataaaaaagataagttcatgtcctttgcagggacatggatgaagctggaaaccatcattttcagcaaactaacacaagaacagaacaccaaacaccacttgttctcactcataagtgggagttgaacagtgagatcacatggacacagggaggggaacatcacacactggggcctgttgaggtgtggtggactaggggagggataggattaggagaaatatctaatggaggtgacgggttgatgggtgcagcaaaccactgtttcacatgtatacccatgtaacaaaactgcagattctgcacatgtaccccagaacttaaagtataattaaaaaaaaaaaagaaagaaaagggatgggataccttgaagccaggtatattcaacatggatattcaacgtggaggtcccctctttccttttctttgtcaaccatatgtgcagtaaagaagcagcaacatggcactggccatgtagagaaaccatttgcttattgaaaattaaggtggggcagacagcttcttcttacactatgtaaatggcacacctggttccaccaatcctttgtgccctatataaatcagacactgtttcctcaagctcatctataaatccctgtgcatttcaccatgggactagaagatccattcgggagcacctttctgcagaaatgagagctattctcctttctctttctttcccctattaaacctccattcttaaactcacttctcgtgtgtccatgttttcagtttccctggagtgagatgatgagttttgagtatttaccccagacaatgatgctgcttaacctgttacttttatttattcttatttttaaaatttttatttattttttatttattttactttaagttctgtgatacatttacagaacgtgcaggtttgtggcataggtattcatgtgccattgtgatttgctgcacccatcgacctatcatctaggttttaagccctgcatgcattaggtatttgtcctaatgctttctgtccccttgtcccagaccccctgacaggccctgatatgtgattttcccctctctgtgtctatgtgttctcattgttcaactcccactaatgagcgagaacatgtagtgtttggttttctgttcctatgttagtttgctgagaatgatggtttctatccatatccctgcaaaggacatgaactcattttttatggctgcatagtattccatggtgtatatgtacacattttatttattcggcctatcattggtaggcatttgggttgtttccaagtctttgctattgtaaatagggctgcaataaacatacatgtgcatgtgtctttatattacaatgatttttaatcctttgggtatatatccagtaatgggattgctgggtcaaatggtatttctgcttctagatccttgagcaattgccaaaatgtcttccacaatggttgaactaatttgcactgccatcaacagtgtaaaagtgttcctatttctccaaatcctctccagcatctgttgtttcttgactttttaatgattgtcattctaattggcatgagaaggtatctcattgtggatttaatttgtatttctctaatgaccagtgatgatgagctttttttcatatgtttgttggccacgtaaatgtattcttttgagaagagtctgtttatagcctttgcccactttttgatggtgttgtttttgtcttatatatttaagttccttgtagattctagatattagacctttgtcagagggatagattgcaaaaaattcctccattctgtaggttgcctgttccctctgatgatagtttattttgctgtgcagaagctctttagtttaattagatctcatttgtcaattttggcttttgctgcaattgcttttggtgttttagtcctgaagtcttcgcctatccctatgtcttggtattgcctaggttttcttctagggttcttatggttttgggttttacatgtaagtctttaatccatcttgagttaatttttgtataaggtgtaagaaaggggatcagtttctgttttctgcatatagctagcaagttttcccagttttcccgttgcttgtttttgtcagttttgtcaaagatcagattgttgtagatgtgtggtgttatttctgaagcctctgttctgttccattggtctatatatctgtcttggtaccagtaccatgctgtttttgttactgtagctttgtagtacagtttgaagtcaggtagagtgatgcctccagccgcttttttttgttttgttttgttttgttttgcttggggttgccttggctatacaagctcttttttccttccatataaaatgtaaagtagtttttctagttgtgagaagaaagtcaatggtagcttgatttgaatagcattgaatctataaattacgttaagcaccgtggccattttcatgatattgattcttcctagctgtgagtatggaatattttttcatttgtttgtgtcctctcttatttccttgggcagtggtttatagttctccttgaagaaatccttcacgtctctttttagccatattcctaggtactttattctctttgtagtgcttgtgaatggaagttcaatcatgatttggctctcagtttgtctattatcagtgtataggaatacttgtgatttttgcccattgattttgtatttggagactttgctgaagttgcttatcagcttatgaaatttttgggctgagatgatggggttttccaaatatagaatcatgtcatttgcaaacagagacaacttgacgtcctctctttctatttccataccctttatttctttctcttgctgattgccctggctagaacttccaatacaatgttgaaaaggagtagtgagagagggcatccttgtcttgtgccggttttgaaagggaatgcttccagcttttttgcattcagtatgatatgggctatggatttgtcataaattgctcttattattttgagatatgttccatcaatacctagtgaattgggagtttttagcatgaaggtgtgttgaatttatcgaaggccttttctgcatctattgagataatcatgtggtatttgtgattggttctttttatgtgatggattatgttcattgagttctgtatgttgagccaggcttgcatcacggggatgaagctgacttgattgtggtggataagatttttgatgtgttgttagattcggtttgccagtattttattgaagatttttggatcaatgtccatcagggatattggcctgaaattttcttttttgttgtgtctctgccaggctttggtatcagcatgatgctggcctcataaaatgagttagggagaattccctctttttctgttgtttggaatagtttcagaaggaatggtaccagctcctctttgtacctctggtagaattcagctgtgaatccatctggtcctggactttttttggttggtaagctattgattattgccacaatttcagatcctgttattggtctattaagagattcaacttcttcctggtttaatcttgggagagtgtatgtgttgaggaattcatccatttcatctagattttctagattatttacatagacatgtttatagtattctctgatggtagtttgtatttctgtgggattggtggtgatatcctctttctcattttttatttcatctatttgattcttctctcttttcttctttattagtcttgttagccgtcgatcaattttgttgatcttttcaaaaaaacagctcctggattcattaattttttgaagggctttttgtgtctctatttcgttcagttctgctctgatcgtagttatttcttgccttctgttagcttttgaatgtgtttgctcttgcttttctagttcttttagttgttatgttagggtgtcaattttagatctttcctgctttctcttgtgggcatttagtgctataaatttccctctacacactgctttgaatgtgtcccagagattcttgtatgttgtgtctttgttctcattggtttcaaagaacatcttgatttctgccttcatttcattatttacccagtagtcattcaggagcaggttgtttagtttacatgtagttgagtggttttgagtgagtttcttaatcctgagttctagtttgattgcactgtggtctgagagactgtttattataatttctgttcttttacatttgctgaggagagctttacttccaagtatgtggtcaattttgtaataggtgtggtgtggtgctgaaaagaatgtatattctgttgatttggggtggagagttctgtagatgtctattacgtccgcttggtgcagagctgagttcaattcctggatatccttgttaactttctgtctcgttgatctgtctaatgttgacagtggtgtgttaacgtctcccattattattgtgtgggagtctaagtctctttgtaggtctctaaggacttgctttgtgaatctgggtgctcttgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggcagatcttcctccatccttttattttgagcctatgtgtgtctctgcatgtgagatgggtttcctgaatacagaacactgatgggtcttgactctttatccaatttgccagtctgtgtcttttaattggagtatttagtccatttacatttaaagttaatattgttatgtgtgaatttgatcctgtcattatgatattagctggttactttgctcattatttgatgcagtttcttcctagtcttgatgggctttacattttggcatgattttggagtggctggtaccagttgttcctttccatgtttagtgcttccttcaggagctcttttagggcaggcctggtgatgacaaaatctctgagcatttgcttgtctgtaaaggattttttttctccttcacttatgaagcttagtttggctggatatgaaattctgggttgaaaattcttttctttaagaatgttgaatattggcccccactctcttctggcttgtagagtttctgctgagagagctgctgttagtctgatgggcttctctttgtgggtaacccgacctttctctctggctgcccttaacatcttttccttcatttcaactttggtgaatctgataattatgtgtcttggaggtgctcttctcgaggagtatctttgtggcattcgctgtatttcctgaatctgaatgttggcctgccttgctaggttggggaagttctcctggataatatcctgcagagtgttttccaacttggttccattctccctgtcactttcaggtacactaatcagacgtagatttggtcttttcacatagtcccatatttcttggaggctttgttcatttccttttatacttttttctctaaacttcccttctcacttcgtttcattcatttgaccttccatcactgataccctttcttccagttgatcacatcggctcctgaggcttctgcattcttcacgtagttctcgagccttggctttcagctccatcagctcctttaagcacttctctgtattggttattctagttacacattcgtctaaatttttttcaaagttttcaacttctttgcctttggtttgaatttcctcttgtagcttggagtagtttgatcgtctgaagccttcttctctcaactcatcaaagtcattctccgtccagctttgttccattgctggtgaggaactgtgttcctttggaggagaagaggtgctctgctttttagagtttccagtttttctgctctgttttccccccatctttgtggttttaactacttttggtctttgatgatggtgatgtacagatgggtttttggtgtggatgtcctttctgtttgttagttttccttctaacagacaggactctctgctgcaggtctgttggaatttgctagaggtccactccagaccctgtttgcctgggtatcagcagtggtggctgcagaacagcagattttcgtgaaccgcgaatgctgctgtctgatcgttcctctggaagttttgtctcagaggagttcccggccttgtgaggtgtcagttctcccctactggggggtgcctcccagttaggctgctcaggggtcaggggtcagggacccacttgaggaggcagtctgcccattctcagatctccagctgcgtgctgggagaaccacttctctcttcaaagctgtcagacagggacatttaagtctgcagaggttactgctgtctctttgtttgtctgtgtcctgcccccagaggtggggccttcagaggcaggtaggccttcttgagctctggtgggctccacccagttcgagcttcctggctgctttgtttacctaagcaagcctgggcaatggcaagtgcccctcccccagccttgttgccatcttgcagtttgatctcagagtgctgtgctagcaatcagtgagactctgtgggtgtaggaccctccaagccaggtgcgggatataatctcctggtgcaccgttttttaagcccattggaaaagtgcagtattcaggtgggagtgacccaattttccaggtgccatctgtcacccctttctttgactaggaaagggaactccctgaccccttgcacttcctcagtgaggcaatgccttgccctgcttcagcttacacacagtgtgctgcacccactgtcctgtgcccactgtctgtcactccttagtgagatgaacccggtacctcagatggaaatgcagaaatcacccgtcttctgtgtcactcacgctgggagctgtagactggagctgttcctatttggtcatcttggctcctcctcctaattcttgaagatttcattggctaaagtaaaacaaaaattctgctcaaaatgaagccaaaatattttgagtatttgcaaaacaatgttgatactatgagtggagttcttaatgttgttgtgttcaaatacaatgtgtgaaacataatgaagctcagtaactttcgtgtgtaacttttggattagaataataaatatcaatataagcccataaggttttatattatttttatttttcttttcttttttttttatggcttggatgacactttattttcagatccaatactagaagttgtttccatgttcacattttccttcctggtttaaaaaaaagagttgtatttttttttttttgctttttttaaattatactttaagttttagggtacatgtgcacaacgtgcaggttagctacatatgtatacatgtgccatgttggcgtgctgcatccagtaactcgtcatttaacattaggtatatctccaaatgctatccttccccccattgtatttttcatagcttaaaaatcattgacatagaataattccagctaaagtacgtattaaatccctggaaaataaattttgtcttaacaaggtaagttgtgaaaagatgttttgtcacaggaaaaaggaaatcctccatttaaaaccctccatgctgaaataaaggaggagtcccatctttcagtcattccacttcaggcttttgatataactaatctcttttcttcttctttccttttttggcaagctttcggaaacaaaacaggcaaaattttgtgatgataaatatcacagttgccacgcaggccagcaggaatgctatcacatccaaagagtggtactggatccaggtgaggttgtgagctgcgactcgaaggtgcttggctcctttgtggcgcatgacaaactcaatccagaagactgctcgatccaggggcttcattggttggtcatgatgaattcttgataatttcatgacattctctttatagctgaaggataaatataaagatatcaacattaaaagtaaatttattgcttaagcatatcaagtctatggatggtctttgaaaagtgtcacacaaatgattgaaagtaagtgtcactgaattggcatgaaatttcaatgttttaattcatgtcattacagaaagtttggtttttaaattggagttttatcactgacaaatacctttaaaaatgaaaaatggaattttcggtgggaaagttaatgttttctggagcagaaaatattatgagccattctaagtgctataagtaagatagtggaaatggaatttgagaatgatctttttgatctttttaatttttttttattttttgagacaggcttttgctccattacacaggctgagtgcagtcacatgatcatggctcagttcagcctttctctttcggtctcaagtaatcctacatctcagtctcatgagaagctaggactacaactgcacaccaccatgcctggctatatttttttattttttacacttttagatatgaggtgttgctgtagtgcccatactggtctggaactcctgtagtcaagtcattctcctgcctctgcctcccaaagtgttggccctacagacatgaaccactgtgcccagcccattttgacgtatttaaagaagaattgtgacacaactggtgaaatgcctcctaactagtttctcagcttctactctaatcttttgtcttctaccatattttccttctagtagccagaatattttccaaattaatatcaaattatgacactcacctgttaagatttccatctggtttcttgttacattaagaataaattccaaatctgtctttggtctagagaactctacacaggcacctacttgtcctagccctttccccctgtacactttcttctagagacaatggccttcggtttttctctaaactcctgaaggtgttctcaccttagcccctttacaccttttgttccccgtgtctctctcattgagcattctttcttgcaactacttgaggtttgcttctatttctttttgaggcttccccttgtatgatacctcttggagagtcttttcctggccacactataggcacccataggatttctctagtgcttcatgcttactttgctatttgatttctggaactttaaaatatgttgtatatcttctacagtaaaacttcaagtatgaaatacataggataaatgtatatatactatgtgactacctcaaaattttaagattatcttaaacattatcccaaagtgaagacaccaatttatcacaaactgcatagaagaactctctcctcctgggccattttagtcactatttttatcctcaaagtaagtattaacctgatttctgatatcatagattagtattgtttatataattgaattaaataatacatattcatttctgtttttggttagcagttgtttaatagcattggtgtagagagtattcagttgattgacaaagaccacagatgatctcttcattttgtgattaatggatatttgtgttgttaacattttttgaccttactaataattatggtattaagatatttgtatattttattaggtttaaatatttattcatttttgttggatgtatacttggaagaatagttgatgagagaaaggcacatttataattagaattttttgttgactgaattttttaaaaaatattttttattttaaagaatcagattgttttcagttatcgtttttggatgatttataatttatttctagtatgactagaacatataatttttatgaatttgaatcttatacaatttacttagtgtttatttatggcccagcatatggtaaattcaggtaactatttcatataatctttttttttttttgagacagagtctctctgtcacccaggcttgagtgcaatggagtgatcttggctgactgcaatttgcatctcctgggttcaagtgattctcatgcctcaatctcccaagtatctgggactacaggtgctcatcccctacatctggctaagttttgtattattagtggacacaggatttcaccatgttggccaggctggtctcttaactcctgacctcatgtgatcctcccactttggcttcccaaagtgtcgggattacaggtgtgagccaccacacccggtctccataaactcttttaaaaatgtttattttctgtctacacacacacaaccagagatatatgtatggatacatatatacagataaatgtgcaatatatatacacacacacatatataacacatagattacatttaattgtgtacttcaaatgttttatctccttaaataaaatatttcaaagatcactattttgtcttttctttttggtctgcttaaatttaatgtgagtactggtaggttcacttttttgtttttttgcttttttgtttttttttgagatggagtctcgctctgtcaccaggagttcagtggcactatctcggctcactgcaacctccgtctcccgggttcaagtgattctcctgcctcaacctcctgagtagctgggactataggtgcacaccaccatgcccagataatttttgtatttttagtagagacagggtttcactatgttggccaggagtatggtctcgatatcttgacctcgtgatctgccctcctcagcctcccaaagtgctgggattacgggcgtgagtcactgcacctggtcagttcaaatttttttaaaaagttttatttttactttaagttccagtatacatgtgcagaatgtgcaggtttgttacatacgtatatacgtgccatggtggtttgcagcaccgatcaacctgtcatctagattttaagcccctcatgtattagctatttgtcctgatactctcactccccttccatcccccggtgtgtgttgttcccctccctgagtccatgtattctcattgttcaactccctcttataagtgagaacatgtggtgtttggttttctgttcctgtgttagttgctgcggataatggctttgcatttcatccgtgtccctgcaacagacatgatctcattcctttttatggtgcatagtattccatagtgtacatgtatcatattttctttatccagtctatcactgatgagcatttgggttggttccatatctttgatattgtagatagcgctgcaatagacatacatgtgcatgtgtctttatagtagaatgatttatatgcctttgggtatatacgaagtaatgagattgctaggtcaaatggtgtttctggttctaggtctttgaggaatcaccacactgttttccatgatggttgaactaacttacattcccgtcaaaaatgtaaaaagctttcctatttctccccagcttcaccaggatctgttgttttttgactttttaatcatcgccattctgactggcatgagattgtatctcattgtggttttgatttgcatttctctaatgatcagtgatattgagcttttttcataagtgtgttggctgcataaatgtctttttttaagaagtgtctgtttatatcttttgcccactttttgatggtgttgttttttttttttttttgtaaatttgtttaactttcttgtagattccggatattagacctttgtcagagggatagattgcaaaaatcttccctcattctgtaggttgcctgttccctctgacgatagtttattttgctgtgcagaagctctttagtttgatttgaccccatttgtcaattttggcttttgttgcaattgcttttggtgtttgtgtcatgaaatttttgcccatgcctatgtcctgaatgatattgcctaggttttctcctagagtttttatggttttgggttttacatttaagtctttaatccatcttgagttaatttttgtataaggtgtaaggcaggggactagtttccgttttctgcgtatggctagccggtttctccagcaccatttatttaatagggaatcctttccccattgcttgtttttgtctggtttgtcaaagatcagatggttgtagatgtgtggtgtttttctgaggcctctgttctgttccactggtctatatgtctgtctttgttccagtactatgctggtttggttactgtaaggtgtaaggaaggaatccagtggcagttttctccatatggctagccagtttttccaaaacatttcttaaataaggaatcctttccccagttgcttgtttttgtcaggtttgttaacaatcagagggttgtagatgtgtagtgttatttctgaggcctatgttctgttccattggtctatatatctgtttggtaccagtaccattctgttttggttatgtagccttgtagtacagtttgaagtcaggtagcatgatgcctccagctttgttctttttgcttaggattgccttggttatatgggctcttttttgtttccatatgaaatttaaagtagtttttttctaattctgtgaggaatgtcaatggtagtttgatgggaatagctttgaatatataaaatactttgggcagcatggccatttttacaatattgattctttttatccatgaggatggaatgtttttccatttgtttgtgtcctgtcttaattccttcagcagtggtttctagtcctccctgaagaggtccttcacatcccttgttaggcatatgcctaggtattttattctctttgttgcaattgtgaatgggaatttattcatgatttggctctctgtcaaatcatgtactgtcagtgtatagtaatgcttgtgatttttgcatattgatttttgtatccagaggctttgctgaagttgcttatcagcttaaggaattttggagctgcgacaaaggggttttctaactatagaattatgtcatctgcaaacagagacaatttaacttcttcccttcctatttgaataccctttatttctttctctagttcacatttaaatccagcatcttattctatatatatatatattttaattttctaacctgttttatgtttctttactttcttactttttttgaagtatcttaaatcatttcttgtcttactaattttttggtaaagtgtttttaatgtattcccttagctggtaccacctaacctcataataatattggtaggagtaatagactctgaattgatggtagctggtctaggcacagcatttttcatagtatttcctttggattatggaaaagttaagtattacatatttattttatcaacattgaaacctttgtatttcaaaaggcatcttccaaaaagtaaaaaaaaaaatctatctgtccatagtggaagaaaatatttgaaaatcacatatttgataagggattgtatctataatatataaataattcttatgaatccataagataaatagaaaaagacaaaatattcacaagattaaaatagaaatttatctaaggaagatgtgtgaatgaccagtaagcacatgaaaagagggttaacatcttcagccataaggaaatgcaaatgaaaaccataatgagagaccactttacacacactagaatggctgtaatagaaagacaggtgataacaagtgttgggaagagtgtgaagaaattagagccctcctatccagctggtggtaatgaaaaatgatgcaaatactttgaaaaacagtttagcagttcttcataaacaacaatttcccatatgtctcagcaagtccactcctagcatctcctcaaaagaagtaaaaacatatttttacacggaaaatatgtataacaatgttcataaatgccaaaattggaaagacctaaaatgtccatgacctgataaatgggtaattttggtataaacatatcaaagaatattatatagaaataaaaatgaatgagttctgatacatcctacaacataaataaaactaaaactaattatgctaagtgaaagaagtcatttatgaaacaccataaattgtatgatttcatttatataaaatatgtgaagagaataatctattgagaaacaaagtaagatggtatttttctaggactagaggtttattgggagtgacttcatacattatgagtttaatttgaattcattaaaatgttctttagggctgtggctttgtaactatgtaaacatactaaatatatttagattttaaattttagtgaatgttatgctatgcaaattataattcattatcacatttcttaaaataatgataataaaaataaatttttgagaaagaatagattcatactttcagaaattttaggtattgaattgaaatatcatatttctctagttatgttctttcttttcattgtgcattctatcattaaaaatatttaaaataattatctacatatctttaatttttttgattttataattcattgcagtcattggtgacccattaaatctgtggggttgaaatgtaactttgaaataaactgtctggtggaaagtaaggacagattttacattggttaaatcacttcaatcccttcaaaattagtctcttaaaaacgggttaaaattcatattcactgttgacaaaataatttataaataccacctggtcacaaaactgtaatactcacacagggtcattaatgactgacttcaatgcattgagcaaatctctacttgacatggtcctgatgtccacactgagggctgctcccttggctttcatgtgagcaatgttatcatgttgatccgcaaacaagggaatgcccaccatagggatcccatggtagatcgcctcatagatgccattggttccaccatgagttataaaagctttggttttgggatgacctaaaagtggatgcattttaacaaaattattaattacaaggtatgagaattgaataagaaatgcacaatataaggaacttaaagcaaaactgttccctaggtaacattatacccacaaaactgcattgaaattgttttcaaatttcagaagaattgccaggtgaacaaaatgaaaaagcatattcttaattaaaaaattaaaatgtgcaaaaaaaagaataagattgggtatacaagaacgtggtcttttaagtattataaataatgaggtcacatttacatatttaaaaaatatttaaatacttaaaatatttaaaatatttaattttttttaaaaggcagcagggagtagggtggaggtggggctgaggaaggaccagttatgcatcatcatgaaatgtgttatcattttatcatgataaagattggttatttattcccataaaaagtagagtcactggtaatagaaaagtgtccgctatttttcagtgcctgttgaaataaccctgcagtaggggaaagaacagaggtaaagctgcataaataggagacagacagaaaatccaggatgttatttaaaacctgtgagaggaaattacacctgaacaaagagatttttattctgaccataaagaatgtgactgtatgtaataaaatgccaactactatagtgcattctttttatactaagactggaaaataaatataaagtagttaaatttgatttgttttttagttttccaataataaatgctaaatatgtttgttttatgttgaactattatcactccaatttgctgttactaatatattcactgtttgttctccagaatcttaccaagaaggtcattctggggtaaccacttgtacagtcgagtattggaacctaaagtatttggcttcttgccatcaaatctccatagaacctgttagggcaaggaaaatatcttgttcaatgaatagaactctaaaaacatagcatgttagaattctgaagagattaataatcagttagttaatccatataaaagatgaagaaataagaagaagtgatgtcaagtaatgagaactactaaaagtttgaggtaagttgaatacccacgtttaatgtcgttacttttataatcaattttgtatataaagaaataatgacatttctaacataatagctagacacatgagattgtgaaaggaaaataaatcttggcaacccaaactctatgctaaagggaaaagttaagctgcttagggcaaacctacctcccattctattcaaagtcagcccttgactcactgagataaatgaatatcaaattgcctcatttcgagaggctaatcagaaactcaaaggaattcagctatttgtctctcatctacctatgacctggaagccccttccatgcttcaagttgctctgcctttgtttctagctgtcccccatttctggaccgaacaaatgttcatcttatatatgttgattgatgtctcatgtatccctaaaatgtataaaaccaaactgtccccccaccaccttggacacatgtcatcaggacctcctgaggctgtgtcatgggtgcacattttcaaccttggcaaaataaactttctaaattatctgagaactgtctcatatattcagggttcatattttggtaaccatgaagagattctgagtggaggttccctgacctttgataaatgtcctatcagtgcttggtaccagcatgagctaaatttatggctcaaacaaagaagacaattggctgaggtctgggagcaacccctccagagaatctctgataccccaaaattcagacaagatctgaagtttattttgctgtacaactcctttttgttttttttggagttttacttgcttcctacaagaaaggcaagatttcctgtttccatgacaatggaaggcaggtaactctatggagtttgagctcgctcccaggagggaggatgaatttgaggtttctttcctgattctaggatggcagagggcagttttggcctgaaacccatccgtaggtaaacagctgaattgcggttttgtcttggttaatgtttaacaactagctggacttaatttctccttaccattacagtgcttagtgatcacatttctgggattttttttttttttgtacattccagtatttctcccatcagatttgatgaactttacctgacttgatcaaatctgagtgagaattccaaattgtgggtaacaaagcctgtctaatttggctaaaattctttgcagacgcaaaagagaaaacaaaacaaaacaaaacaaaacctaaaaaccatgctcttggtttctgtgtttgcttcctgtctttaaaaaaacaaatgttcttttgtttacttttcctccaccctatacctccttttgccttttgccatttgcagtatgaaaaatctagagaaggcttctaatgacttgaactcttttaaagaattcagaacaaaggcaccactcacccctttaggggtgtctgttttctttgtggagttccaagagttgtgggcagatttttttctcagtccaaagctctgttttcctatgttgaatgacctgatctctttggctttgagattaccacagattaccttgtactgtgagaggattttaccttggcatgtgtaatggcagacgagttacaaagtagggggtggctgagtacagtttactggaagtagtattgactgttgctatttttttcctcctaggaagttgttgtttaagaatcctaattctagtttggagatgtgttgtaaagggtctcctctattgtttttattccccaaattaatctcatttggcttgtctgtgtggatttgtgtgagaaactgaactgtggtttacataggaaaatgagagactgagttttctcagctccaaagtgaaagggcatctgctcctcccaggcaaaaggcacccctaagcaactgggggccttgtgggagtgtcttggggttgaccccctgtgacatggagtggccctgcagggaaatccccaagaaaaattaacttttaaaaaaaggctagtccaggaaacacatatgagggcagatcacccagcattttgagccctctcagaggtcatacacctctggagagagaaactgagacatgtaagagggtggaaacaactcagtggtgacacactgtggagtactgcccacaagcagcacacattgattcaccacacataaaccctaggccacagctcagttcctccttttaggaaaaaaagtgggaaacaaataatctaagaatgatgagaaaacaagaagaatgaccccctgatatcacttggtaggttttatgacacctctacttggcagagtttatgtaaaatgaaggtaatacggtctttgtgcacatatacattaagaaccctaggttgtcctgcaagctatagagttcctaagttctctctttttaaaaaaaattcttttcttcttgctttaaatttgcttttatttttctattaagataaaaaccacactatggattcaacaggtttttgtctgcaagctggtcaattttttttatctcatggctaaagttctgaagtaaaagccatagaatcttttgtgtgtgtgtacatgtgtttgcatatatttaaaaggccattataatttctataattttatgtttaataggcaattgaatccattttattttccttccagcacaccaaattttttgtctctgtaccttatgatgtaaattttgctatttaattttcacttggtttcttttaatatgcaaatgtaagactatttagcttacaactgcctatggtgatcaagtattcatacagattacctattgaaacaggttatcaagaatttggaagtctaatatggcaaaatgtagttttcataaatctataagatgtacttctattggcatgcttaatgtgtgtatgtatttatgtgttttgtacacaatgttttattactgaaaatatataaaagagctctaattaattggcttaagaaaataaaagtgcttgaattaaatactttgccagaaaaaaaagactagtcaaatgctttttcaagtttatgtaacttcaataaaatcttttataaataagataactttacaattattgctaaagtatgataatattagaaatgtcttaagaatttccagcatatatttttgtttgcatttattaatcaaacaatttcatacttattgttgccaaatactttaaggtgtcaaaatttgacataagggttacaaaactgtaaaccaagcacaaaacagaatgatctttgcttgtgtaattttttaataaataagacattgatattggtttaatgaaaatagccacatcttgaattaagtaagattatcataacttctaaccctgtggccttaagcaatctagtccacaggcagtaaggtttgttttgggaaaaaactgttatcatttttatttcaaagctaaaccataaagggtgtgaaatggcaacactatccttcaactcattttcaactcatataagtttttttcctcaagttctgtttgttgtggcataatgctaacagtgctttctaaaagctattcagctcctcaaggtccagggactatcacagaagaggtgggtgtgtgagattttaagaactgatactgagagataagttagtttatttacaaattaatcattaatgtcaaagacacactaatgcaagaccaacatatgggcccctgtgtcagattaacaaggttttctggaagcataaactgacttcttaataaagattataaaggttatgaaaggctgaggaaagttatatcttatggtcaagattagaattttatagattgttcataaaattttgaaaaacaaagttatttggcttcatgctattttattagggcttattgtttggcaaattgagtctcctctctcaaagaatgaagatttttgcctttttttgaaatccttgagttaccacattagtcaaatgaatgatttatcttacctgtgatattaagtgttttaaacctttgatatttgagaaattttccaaacaaattataaattatgattttttctgacctaagtaatcctttaatttattagtttccctaacatccaaaaatgacataatttggtttattttgtataaaaattatacaggaaacattgtcaaatatgaaatggtgtttggtctttttgagctgtatttatataagtatgttattgttatgtgttccaaaattatgggaaactcctataattctgatatgacttagtgtgtacgttatcagtaacaattatatgtgttaagttattgtgtgccacagaggtaacaaatttccttgtccattgtgtctttgactgagtctgccctaaaactttttgtcctccacagacaattgttgtcttactttggtcctctttagaaggcgattttatactcagccataaaattctaacaggtgctcttgaaaaaaagtttttgataattttggagattgtgacattagaatggaagaaaaactttcaggactcatggagaactaaaatgttcatgagtatcaagcagaacaggaattaactacatggactgaaataataaaaaactaaagtaatcttttagactttgcttaaaacattgctgatcctttgttttgtttttttttcagagtgaaggaatctttttttttttgagctattaacagcttttaacaatttagtatactcctatgaaaaaaatttagaacatatttgtttccctctacctgatttttcagaatttggaaactatttgtgagtattttttacttttgtcaatacagttatttgcataagtgcaataagaatctattttcatttttaacaaaacacaattggagaaactggttattttatcaaggcttccactggtatggtgggctttcctttagggaatcaaacttaacttatggagccaataaaaccccttgggaaaactggcctcataccttcatctataaggtccctgtacagggttcctgaactgtgttaagcaaagaatgtaactttctgacaggcccaggaaccccaagtttattttggaaccccaagaggagaggaattcacccaactcgtaggtatttgatggtagaaatctatggctttcctcagctttaaaaaagtcctatctgagattctttctataagacaaagttccatcaaagccactttaaaagcctatgtaaataaaaaattattcttcctcctctgtatacaataatcaggccaagtataataaagcaaatcagttgtaccatggtttgtctttagtaaaattgggaaactgaagacagaaaaattatgtttcaaaaataacagtatacctgttgttagattctagtcttgcctaatgtttttcaacttttattactgtctacagtttggactgaattctaatttttcatggctacacgtcttcaaaatagtgtcttcaggttttttttcctccctttccaccatttttcctagtttggagtcactgtaaactaagtcatgctttcataaagccctacaaattaagctagacaacttaaacttcagaagaaaataacagcagccaatttacatacataatccactttcttacctgcctactgatttatggacttcagagtaatgggcctatattaattttcaaggatttttcttttgtttggttttgtttttctccctttctccctttattttgtcttcataggacatgagacttcacaacctactaaaaatgaactttcctaataactcaggacctgcttaggaataaaccttccttgccattagagatcagatgaaaacctgagaccagagactcattttcttctaaaatgctttctccaaaagattttttttaaatgtaaaaggaaaataagcctgggggccccaaagtcactaagcaaatcactgcctcccattctattcaaagtcacccctctgctcactgggataaatgcatatctgattgcctccttggagaggctaatcagaaagtcaaaggaatgcctcctccctgcttcaagttggcaaaaataaactttctaaatgtactgagacctgtatcagatatttggggttcacaagattatcaatgaaatattcaaatatttaagaattgttaggcagtcttaattctagtaataaaaaagtagcaaattagtaataacctatatatttattttatatactttatactagctgtaaccttccaaatttaatataaatttattaatttttgagtgatatgagaagagtttacttatatccacttgtctactagtcataagttattttatgaatttgacatcattgattacaaaagactaaatatttaaactgcacatatggtgagaaataatgctacatatgtagtatgtgtaatttcttttcatttgctaactatcaagtgctactttcaggaaaaatttcaagtggcagtgtttgacacaaattcagactattatcagtattgctacttttgtaaatgctaacaatgtaggaaaaaggagcccattgacaattcatgattaacaatacagatgctgaaaatgtagaaaattgtattttgctgcattttgcttaactgatctttcacacttagatgatgcactacctagcattgacagccttgatatatggtcagctatagccagtcattaccatgtctagtaccaaactaaggtactgattttagaattcccaagcaatctttataaactggagtagaatttacaagtgttgaccttgtatttgatatgggagtgttaaagtaactctgtgttttcagcaaaaacttgcatagatcattcagagagggctatgtcagataagaaactaaaacgtaaattgaaaatacacaaagattgtatagattagaaaataagttcctaccatgtttatttatattttctgctccttcctcaatctggagaaggcactaatctgattcttagagcatagtctttgttgggccacatttaataatgcacatagtctaccctaaaagcaggattctatctccatcctttccattacatttttctgcttaagacattagtggcacccaagtcagcagagcagacaagttttttttttttttctctaaatctacttggctaggtgggtacctccagagcagtggctagtcagactaggacattctttctctgaatggcaccctgaacagaacgctaaatagacctattccaatgcatgggaagtaaaaacagccagattgcttggtaagacgaagctgcatgatgcatttcaaagttttttcaatacctgcttattgttattgtgatagtacagtaacttattaaaatttaactgctttttgataatatctacagtgtatacagtaccttctaaaatcctgtaaaccaaaaggagcaaatgacagggcagaatttagtgatttctatgtacatgctacgataccatgataataccaaacttcactagcacctcttaaatatatttccttctgatcacaatattaatgccaacgttattatcaaccaaaactcctctctttatgattttaagatcttccatatatgtttttgctttgaacagatgtctgagataattagaactatcatagcagttaaattttcaggcagaacatttctgtaatggactcttgaagagtttaacagattcatttagtagccatccacagttaaggcactttatctaaccttttgtgggatctgggcaagggctgatgcaatcatgttggcactttcttctgacatgttactgatcatcgaccccagagaaaacaccacaataccattttctccagagctctgcacaaactcttccatttcctgtgaagaaagaatttgttctatcagaaaagagcaacagcacagaaaacactattgacaggattgttacaaacatctaagatgagaaagtcaggagctattggagtaatttttttaaactgacctaatcattcagtttctttgaaaggagatgtgtaatataatatatgtgggatctttcatgcaaatttgtgtaaatatgtgtgcatatgcatgtatgtatgtgtgtgtaaggaggaaatgaaacaaagctatgacactgcagtaggaggagataatgctagaaaatgttacacccagacactttatttataatattataattactaacataggttattggaaggtagctttacttggcttcaattctaattttttttgtggttctactaaatctcttgtgtttatttggagtagttttattttattttatttttttctgttcagttcttttagttaggagtcattggagccattacatgactatgagcaatgaggaaaagttagttacaattggaatgatattatatctacatttatttagcttctagctctctaaccctttatatttcacttaaagttagggtttcctagtcttaccccactacccctcactgcccccgacacccccaccccccaaaaacaccttaaaagctgaagtataagaatcactgacattcagcagtctggtattgtggtttggaatttctgggaaatagttctgagaattccatttataatacagtattatatactatatagttacataattaagtgatcttatttctcaggtcattgcttaggtatgactatgacaccttttgtcctgaaatcacactgtgaatttgatgtgctatgtataactgaatgtgggggaccctcatcatcactttgctgtgtctcacagggggcacttgaaccacagtgggagaggtcaccaggactttctccagtggagatctgctcaccccctagagtagctccctcacactatatgaagctcctggtgaatatgtgtttgctttgaaatgaatgagaattattctgacttgtgtttcctgatgtgtccctgtttttaaacttaaatccattctctaatgccacatcgctcaatgtattctcacaccaaaaaaaaaaaaaagagagagagaaagaggaaaagaaatgtagacccataagtttcctggatatcatatcaaaattgtatactcatctttttgttgctgttgtcccttttgttctaaattctctttttctcagtaaaataatgaccaaccccttctgtcataacaaatatactttctggtcctaatcattgggggaaatttctttataaaactgtttacaaataaaaaaagaaattctaaaatatgtcaattcagaccatatattggtaagtatttttaaaaaatataatttaactttatgacatcttttttttttttccagatggagtctttctctgtcacccaggctggagtgcaatgatgcaatcttggctcattgcaacctctgcctcccaggttcaagcaattctcctgcctcagtctcctgagtagctgggattacaggcacctgccaccacgcctggctaatttttctgtttttagtagagacaggtttcaccatcttggccagagtggtcttgacctcctgaccttgtgatccacccgcctcagcctcccgatgtgctgggattacaggcatgagccactgtgcctggcctgacatcagttttaattggagattcagtgtatggctattagagataattcatgaggcatccaggaactcagtgtaattgcagttgcctgtagccacatttaatgtaacttgagttcaatgttttgtctcattcactgccaaaagtctgcttcacccacccagtattgaagtaataaaacatctatttatagacagatcagcactgatctcattctgtgatgtctttatgaaagtaatggtaatagaagatcaatgtaagtagttttataaaagtatgaaaatttagaaaaagaaaatcatttacccatatctctatctcaatttaaaatgtgtaccatttcattatgggtttaattctatttatataactcaatgtacatatgtgatgtttatttagaaaattttattctcattgtatatgcctttttattctacaaaaaaactgtgatcttgttctactcatcattttgttccttagtttccaactatacctgtaccacggctgacagtgtaattaaacattgttttgaaaaaaggattgtaatggcttggtatgcacattatgtaagtttttaaccatttcttaatgtaagatatttgaattatttccagagtttttttaatgagtatttgctaccgatattgaatcttaccatcatgatttattctctgtacagtttcatgtgagtatattataaaggcaatgcctatatgcatttttcaaacacttgatactttttggcaagagtcttattcttttgaaatatacaaacattatctgagaatctaatacataatggaaaagcaagcaaatttgtggcaacaattattttgtgtacaaaagaattagagaatcagtttcacaattatttacttggattcaagtctaccttctgcaagttaacaacaacggaggctcacacttgtaatcccagcactttgggaggctgaggcatgtggatcacctgaggtcaggagttcaagaccagcctggccaacatggtgaaactctgtctctactaaaaacacaaagattagtcagatgtgttggcaggtgcctgtaatcccagctactcgggaggctgaggcaggagaatcagatcgcttgaacctggggggtggaggtttcagtgagccgagatcatgctagtatcagtaataatcactattgtactactagtcatttatcccttgtccttattctgctactctcttccccctgctactggcactatcactttcttttaatgtgagtgaggaatttttttttgagaataagataagagtacacagaattaccttttaagctagaatattaatgaagagcctccacctttacaatacaactttagctttccagcttgttcaactgactgcccaaacttaaacatttacatttaaacaagtacacagagtatctgttctctaggactttgctagagaatataatcttgatgtgttggaaaatcaatcactattaaatgaagactgatatcttaaatggctggcacatgttagctaatttaaagtattaaaaataatgactaaaataatcataatatcaacaatatttttggatcactggctgtgtgtcagagacaacttaagtgttttatctgtggtaactactttttttccacacagcacaatatgaagttgtgattattattataaaagtagtcatgattgcttaaactcatgtaaaagttcctaaatgatctttacattttacaaacttgcctttttgcaatattatacattgggaatattgggattttttaaaaggaaatctgatcatatctcttcatttcttaactcttttcactcttttcagtagctctccattgtccctatgggtatatcaaattacatatatatatatatatattttttttttttttgagacagattctcactctgttgcccaggctggagtgcaatagcgtgatctcggctctctgcaacctctgcctccggggttcaagtgattctcctgcctcagcttcccaagtagctgctattacagtcacctgccaacatgcctggctaacttttgcatttttagtagagacggggtttcaccatgctggccactctggtctccaactcctgacctcaggtgatccacctgccttggcctcccaaagtgctgggattacaggtgtaagccaccacgcccggcccatcattgacttttactcaaccttttcctgtaaattaaatttggagttcctgggaactgcccttattgcttttctacttttctgccttaatgcaagcctttactttttttttttttgtttatttgtttgtttttgagacagagtctcgctctgtcgcacaggctagagttcagtggtgtggtctcagctcactgcagcctctgctcccagactcaagcaagcctcctgcctcagcctcttaagtagctacgactatgagactacaggcacacaccagcatgcctggctattattttattttttatttttgttagagatgaggttttaccacgtttcccaggctggtctcaaactcctgagcccaagcaatcatgccttctctgcctcccaaagtgcagggattataggtgtgagccaccttgcctggcctctggttttctttttgggtgtttctcatcccctcatcgtttcacctatctctgcacattattgagtactcactttaattgtcaatgagtttgggatctcttctgcatatttctttatcattgtggtctttccttataacactttttagacttttctttttcattgtttttattctatctttcaaagtacaatgtaaggcatgagggagcagaaactgtgctacctttattctctgaaaatccagcacttacctgtggtttgtattaatcactctacaaatattttttgaagaaatgaatcatactatcttttgggtggcacaatgaaggccttactttaaccaaccctgttttcaaaatctccctagtaaacctctttggtctttaatgataataacattcacatacttgtgatactacagaaatatatgattttctaatggcaagtccttgtttttgacctcccatattcccctcactctgagttaaacactctgaaagaaacatatccagccattccttctgaaaatgtcaagcaaacaaatgaaacaagaacacatttaccttaggcaggggtttggctggtttacagtgaagtcctccaacaaaatcaacatttggtaagaatgggcgaggaaattcaaaatcccaataggttcgaatgagccacatttcagctttccccattgtctcaaataatgtagtgggtcttcctgatggaaaaaaacaaaacaaaacaaaaggtagctaacacgagaattgttatttgaatatgcaggtattttcctgaaaggacttggaataacatacccaaacatatataaaatgtctgtgcattgataaaatatatataaatacatttatatatagtcataatttagattttatttattgcatatgttgctcatatgtatatataaggaaggcaatgtattcagagatctgtaagaagaaatcacatctttaatgtaacatcagtatattcacaatcataaataattattaaaataagtcactaatatggtttgactgtccccacccaaatctcctctcatcttgaattataatccccataatccccatgtgtccagggagggacccagtggcaggtgattggatcatggtgtggattcctccatgctgttctcatgatattgagtgagctctcatgagatctgatagttttataagtgtctggtatttcccctgcttgcacttctctctcctgccactaagtgagaagatccaagcttgcttccccttagcctttcaccatgattctaagtttcttgaggcatcccagtcatgtagaactgagtctattaaacttcttttctttataaattacccagtctcaggtatttctttacagcagtgtgagaatggactaatgtagccactatgaacttaaatacacatttgtcttccctctgaagctgcaatagtaacaaatatacctttaaacaactctttcagttccacaattaattcatcttaccttacccatgaaaacagctttccaggaagtactctagtgtctacagtttattaagctagtcccttgatccttggttctcaaagtaaaccatgagttttttgagctcaacactgaaatctttacacctactactgtcttggttcatcttaagatcttaatataattagatttttaaaataaatatatttacaaatgagaattaaaacattttcagaatttattgacatagagatatgtgctctcccttaatttggcccctattttctttgatggagagatgcagtttaataaaatatagattaaaacttagatgttcactttcaacaagatttcagtttttgaaagaaataattgtcaacctgttattgaaggaatgtataaacattagaaatctcaagttttaggcttctgtttctggagtagagccactatattactcaactgtgaaggaatccttcttacatgaaaaacaaaatttaatttctaaatgaggaaactgaggaactcaaagagaaacaaattcctcaatcctgcattgataatttttctagaaatatgtgtaaatactaaatttacgtgtctgccttcatgaagatgtttcttgaggtatctattgactttttttaaagatgaaaaaatgtatagcaaaatgatatgtgatagtttaaagaaatcattagtgctttacaatgaaggtttatgactctctgggtgtcctgtagtagtgatggccccagggttctaactgattctataaggtcaacattctataatatttttgagactgatagatcatcttacatttgcaattcataatttcccttaaaaacactatcttctgacattatatttatataagctcaccttcaaaggcacagaaaagttagaacttaataagcaccagttagacacatgacttacctagaacttcactataaaactggtcccacttcttcagatcataaatttgaaaccaaaagtcaaaataaagcatatgtatcatattttttatcctctccatgaaaatcatttgatcacttaattctgacataacaacaggtacataggaaggagggaacagaaatcctccaccattcttctcaaatgtgtagccaacagagaatcgaagactgtacagaaagggtatgttaaatagttcagccagtagctcaccacagggattaagggcatctgccagaatgacatcaaactttgactcttgtagtttcatcataagtttcttattcaaaactgcatctttacagagcttgttactgtagtcataatattcccaacacaattcttgtaattgtgaaaaatatgaccaaaatgtattttttgaaacaccatatatccatctatcgagaattttcagaagagaatcttccaaatcatttttagttaaagatgtaggataaacttctaatttaatagcagatgatttactggcattgacaagagtagaagccgaagatgtcaacacagtcacctcatgacccctctgaacaagctcttccaggattgtcttcatatttatccaatggctgtattctgtgggccacactagcacctttccacagcttccagagctaaagtaacaactgagctgtatcagcagaaagactgacgtccatttcagagacatcctggtcttatgcaatgcttcttttccagttgttgtttctttctgtcatttctcatacttatatctgaggaaaaatcaatcaagttaaaatataactgctaaaatttgaagtaaatacataatactaacagtctgaataggtgcatgccaaggagaccaacaaaagattgatgacctcatatttattttagtgtgtttggtgttcttttatgtttacaattactctagtcaagcaataatttttatgacctagaatatgtaagtaacctgtcttatgtaattattttataatactgttaagaacagtggcaagtgagaggctcctgcctgttcggtgcccttgacatagagagaagaagtaattatacaactcaaacggcattttttaatatcgtggtgcaagtaatgtcttctaaaactttgttgacacataattcatatgccatatgactcaccaattagtgtgtacagttcaatgtttcctagtatattcacagaattttactttcactacaataatcagtattatctccaaaagattctatacaatagcctctaaccccccactctgaaattttgcatccatcctaccctaggcaaccactaatctaatttctatctctatagattagcattttctggaccctttaaaaaataaatgagggttttccagtgatcatggcagatgggatgcaggactagattgcagctccagacagagcagcatgcagaggcttgcattgtgaattttagctgcagatcaactgcaagaacagaccagcaattctgagaggatccacacaccctctgcaggaagcgtactgctcctgcaggacctgggagacatcccaaacactgtgagtgccccaacaatggaagtgggaaagggtgatccccctctccagaatacacatccccactggagaagctgaagttctgttggcaggagaagttcctgactttatgtgaagctgagtcaaattagagaaccaagccaagcaaaatacaggggtagaggaagtagcagaaaggcactgggagctctctggatacccaagcggctcattcctgcctggcatcacagggatctatcaggagggtggccagtgatgcagggggttcaaagattctcctcagggcctgaaggcttgaagggatgagtaactcctcccttctcaggcccagccccaagatgcaagaccacttgcatcagcagcgtgtgtcagcaagatagcagaagcaggaagagagccggccagaagacacttaccctggctggaagagatgtacccctgaagatcaagaaataggccatccaggtactacatagcagtcacaacagactgggacacttactgtttacagaggactacaaaacccctgtcccatcctcactgggggctgatgccattttaggcctcagcccacctgcaaccaggcgttcattaaaacagcatgttgctccacaccgcctcctgttgtctgttggcgcgctgttggggttcaaactgattcaagaaccttacatctggtgccaaatcctaggaggggctcaggtctgtgtcgcttgtggacctacccctccaccccagagagcaggccacagcaattagacagaggaagctcctcagcctccagtcgcctctctgtgcatgcgcatcagccactgatctcgcctactggtaagtttcccttggagcccggttaacagggcaaaatctacatggcctctcttggtttctccagtccaaaaatccaacactgatccaagaaggcgccagcgtgcgccaggcactcgctggtcatctggtcttagggggatgcctctaagccatttcatcccattccaggaaccaaaaaggcagcggagacgataactccttttatcgtctccctccagctgtccaggatggtctcctttttccctgttctctcgagctacccttcattatgggaaactcccggtcctcaattccaaaaaacagccctccagcctgcctcattaaaaatctgcaaaccttaggcctcaggcaagatatctgccataagtgccttgtcttttttatacgataaagcctggtcgcagtatgaattagataacgggtccaaatggcccgcaaatggaacactcagctttacagttttaactgacttaagcagttattgcagatgactgggaaaatggggagaaattccttgtgtccaggcctttttgcactcagatcacagcccgacctctgcaattcttgcttacctgttcaaatccttcttcattctcgccgccctcattgcctttatcctcccgaccctacctctttttcctcattggatggagcagactgctgtccacccctcccagaccctacccctccatctcaaccaacttcattaactccccaagcttcctcattgtcttctcagccaccatcttcccagccaccatcttcccagccagcatcacccacttcttttcctataccatcctctcctcaggaaaactctagcattgcctgtactcattctccttccttacagccctctcacggagcctgtaaacccatcccgccaccttacacccgtatctatcctccaatgcctatcaactcaaccccccttccctcttcaaaccctcagcaggaaccccttctggcttcttccttctctcctgcccatactagctccggcaccatctttggcccccatgccccacccgtactttagcgccagtgctagaatgcccccttcgggaagtagcaggaactgaaggtattgttagagttcatgttcccttctccctcactgatctctctcaaactaacaaaagactcagttcatttccagaagatcctacctcttatattagggagattcagtaccttactcagtcttatgaactaacctggcatgacagctacttatcttctcttccaccctcaccccagaagaccagcaccgtacttggaccctagctcaggtgcatgctaatacaattcatcatcaagctcctgcccagcctactggcacagaggcagttcccaaccaggacccccactgggattatcaagacagggcctctggacacagccatcaagacctcatgattatgtgtctccttgcaggactcaaaaagggtgcccataaagtggtaaactatgaaaaactttcagaaatcaccgaaggtcctgacaaaaacccagccctttttctctcttgtttaactgaagccatgagaaaattaccaacctggacccagccagcccagaaggaaccactatttcaaaccttcagttcctcacccaatctaccatgatatttggcgcaagcttcagaaggttgatgacggccctcaaaccccacagtgggaccttcttaatttagccttcaaagtctttaacagttgtgatgaggaaagtaaaagaaaaaaacagtttccaatgcttgcctttaccctgcaggcccacagggccacagctccatacagaagcctcctagcaaaacacctccacctggcgcctgtttcaagtgtggcaatgaaggctactggtccaggccatgcccaaacccagctgtgctcaccaggctgtgccccctctgtggaggactcagtgaaagtcaggctgtgagcggctccagcaaggatcgcctccatccctttccgagctggccaaaacctcctactcggatctcatcggccttgccactgaagactgacagtgccctggaacagatgtcccagcaactaccattgcttcatctgagccaagggtaactctgatggtggcaggtaggcatgcatgttttttaaaaattaatattggagcaacctactctgctttacctaaattttcaggacccacccagtcctcccaagtctctgttgtgggaatcaatggacaagtctccaaaccccaagacccccctccacttttctgctccctgaacaccttttccttcagtcactctttcttagtcctgccttcatgcccagctccgctcctaggcagagatattctttcaaaactccacactactctccacttccacattccccatagtacccaacacatcaacccagacccctccaaggcttctaacaggcttctaaccttcttctactcctccgacctcccaccctgaaacatgcaacttttccttatcccgcacctgtagttaaccccactgtttgggatacttccacaccctcggtcacagagcaccacacccccatccacatcacccttaaagagcccaccccgttcctatcacagaagcagtatctcatcccccaagcagctctcataggcctaaagcctatcatttctctcctcctcaccagtcacctactctgcccaacaaactctccttttaacacatcagttctacctgttaaaaagccagatggaacttatcacttagtccaggacctcaggctcattaaccaagctgtactcccagtgtgtccagtagtttctaacccatatactttactttcctcacttccctcgaataccacccatttttctgttctaaacctaaatgatgctttttcacaattcctttacaccctgattcccaaaacctctttgcctttacctgggaaaaccccgacacccacctttcaggtcagctcacctggtgcgtactacctcaaggttttagagacagcccccacctttttggacaggcccttgctagtaacttctgtactttatccctaaaatcatcctctcttctttaatatgttaataatctgctcctgtgtagcccgtctcaaagagactgcaacacccatacatactatctcccttttaaacctcttggcagaacaggggtatcaggtctcccctaagaaagcccaaatatgcaccccccagtcacctatctaggcctagctcttacccctgaatgcaagggctcacaacagaccacatactccctccttctgtccctcccgcctccacaaactaagcaagaaattctctcttttccaggattagcaggatattttaagctctgggtttcctccttcgctctacttaccaaaccgttgtaccaagctgctaaaggccctctccatgagcctttaaaacctgcacagcctattacccaacctttccatctactccaaaagtctctcatctcagcccccatcctcactctcccagacttcaccaaacctttctccctctataccgatgaatggcgtggagttgcactaggtgttctaacccagtctaagggacccacccggccaggttgttgcctacctccctaaacagcttgaagccacagttctcggatggcctgcctgcccctgagcattggtggcagttgctgtcctcactcttaaaagcctaaaactatctcttcatgccaacctaacagtttattcaacccataacatcaaagacatgttagctcaccgcagtgtactaagtcttttctctgccccacggctcctccagctgtatgctctattcatagaaactccccacatcaccatgctaaccacctcccatctaaacccggccatgctcttacccgaagctacaaccgcccaagactcttcttcacactcttatgtgtgaatactgttcaaacctttcttataccttttccaaacctaacagaaaaatcccttccagatgcgtcctttactcggtttgtagatggcagctccttcctacatcaaggacaccgacatgctggctatgctatagtgtcaccccccaacactattgaagtcaatctgctcctcttaggcaccacctcccaaaaggctgaactcattgccctcactcgagctctcattctagcatccggaaaacagatcaatatattcaaattctccttatgtgttccacgtagtgcactcacactcatccatctggaaagaacggggtttcctcactgcaaacaatactgtcataagtggctctctcatcagcaagctccttcaagctgccaggctcccacagaaagttgccatcattcattgcaggggccaccaaaccccagacaatcctaaattggctggaaatgtgctagcagatcaggtagccaaacaagtagccctactaccctttcgaggccagttgctgtccttgtccttgttctctcctctttacttctaagaagaaaaagatttccaagcccaaaaccttcaaaagcaaggacgatattatgtcaaggaagggtgcttagttattcctcactctcaaagccttcctcacctccaaagcctccacaactctttccatgttggttaacaacctcttgcagcttctccacgctattctcacttgtcgtcacttttccagccatgttcaagaaattatccagtcctgctctatctgccactcaatgtaaccccagggatccctccagcctctgccttttcatacccaccaagcccagggccaggtacctggggaagattggcaagtagacttcactcatatgctgcatgataaatgtctctgctatcttctaatccttgtctgtactttctctggctagggagaagtgttcccaacaacttcaaaaggtgcaaatatcatcacacaaactcatcatgcatacagttccctgtttcagactcccaacatccatccagtccgataacagtcctgccttcatcagccacattacccgaggcatctctacatccttaagaataagtaagttctccacacaccctacacacctcaatcttcaggcaaagttgaaaaaattaactctgtccttaaagcctaactcatcaagccggctctagaaacctgcgagtcatggacaaaaaaatctcccttttgccctcatgagactttgcacaacaccaaaagcaccctctttttttgtttttgtttttgtttttgttttgttttgttttgtttttattatactttaagttttagggtacatgtgcacaacgtgcaggttagttacatatgcatacatgtgccatgttggtgtgctgcacccattaactcgtcatttaacattaggtatatctcctaatgctattcctcccccctccccccaccccataacagtccccagtgtgtgatgttctccttcctgtgtccatgtgttctcattgttcaattcccacctatgagtgagaacatgtggtgtttggttttttgtccttgtaatactttgctgagaatgatggtttccagcttcatccatgtccctacaaaggacatgaactcatcattttttatggctgcatagtattccatggtgtatatgtgccacattttcttaatccagtctatcattgttggatatttgggttggttccaagtctttgctattgtgaatagtgcagcaataaacatacgtgtgcatgtgtctttatagcagcatgatttatagtcctttgggtatatacccagtaatgggatggctgggtcaagtggtatttctagttctagatccctgaggaatcgccacactgacttccacaatggttgaactagtttacagtcccaccaacagtgtaaaagtgttcctatttctccacatcctccctggcacctgttgtttcctgacttttaatgattgccattctaactggtgtgagatggtatctcattgtggttttgatttgcaattctctgatggccagtgatgatgagcattttttcatgtgtctgttggctgcataaatgtcttcttttgagaagtgtctgttcatatcctttgcccagtttttgatgcggttgtttgtttttttcttgtaaatttgtttgagttcattgtagattctggatattagccctttgtcagatgagtagattgcaaaaatgttctcccattctgtaggttgcctgttcactctgatggtagtttctgttgctgttcagaagctctttagtttaataagatcccatttgccaattttggcttttgttgccgttgcttttggtgttttagacgtgaagtccttgcccatgcctaatgtcctcaaagtattgcctaggttttcttctagggtttctatggttttaggtcaaacatgtaagtctttaatccatcttgaattaatttttgtataaggtgtaaggaagggatccattttcagctttctacatatggctagccagttttcccagcaccatttattaattagggaatcgtttccccatttgtggtttttgttaagtatgtcaaagttcagatggttgtagatatgtggcattatttctgagggctctgttctgttcccttggtctatatctctgttttggtaccagtaccatgctgttttggttactgtagccttgtagtatagtttgaagtcaagtagtgtgatgcctccagctttgttcttttggcttaggattgacttggcaatgtgggctcttttttggttctatatgaactttaaagtagttttttccaattctgtgaagaaagtcattggtagcttgatggggatggcattgaatctataaattaccttgggcagtatggccattttcatgatattgattcttccttcccatgtgcatggaatgttcttctatttgtttgtatcctcttttatttcattgagcagtggtttgttgttctccttgaaaaggtccttcacatcccttgtaatttggattcctagatattttattctctttgaagcaattgtgaatgggagttcattcatgatttggctctatttttgtctgttattggtgtataagaatgcttgtgatttttacacattgattttgtatcctcagactttggtgaagttgcctatcagcttaaggagattttgggctgagatgatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctttcttgtgccaattttcaaagggaattcttccagtttttgcccattcagtatgatattggctctgggttgctcatagatagctcttagtattttgagatacatcccatcaatacctaattcattgagagtttttagcaagaagcgtcgttgaattttgtcaaaggccttttctgcatctattgagataatcatgtggtttttgtcgttggttctgtttacatgctggattaagtttattgatttgcatatgtagaaccagctttgcatcccagggatgaagcccacttgatcatggtggataagctttttgatgtgctgctggattcagtttgccagtattttactgaggatttttccattgatgttcatcagggatattggtctaaattctctttttttttgctgtatctctgcgaggcttcagtattgggatgatgctggcctcataaaatgagctagggaggatttcctctttttctattgattggaatagtttcagaaagaacggtaccagctcctccttgtgcctctggtagaattcggctgtgaatccatctggtcctggactttttttggttggtaagctattaattattgcctcaatttcagagcctgttatcagtctattcagagattcaacttcttcctggtttagtcttgtgagggtgtatgtgttgaggaatttatccatttcttccagattttctagtttatttgcatagaggtgtttacagtattatgtgatggtagtttgtatttctctgggattggtggtgatatccccttaatcattttttattgcatctatttgattcttctctcttttcttctttattagtcttgctaacgatgtattaattttgttgatcctttcaaaaaaccagttcctggatttattgattttttgaaaggtttttgtgtctctatttccttcagttctactctgatcttagttatttcttgctgtctgctagcttttgaatgtgtttgctcttgcttctctagctcttttaattgtaatgttagggtgtcaattttagatctttcctgcttcctcttgtggggatgtagtgctataaatttccctcgacacactgctttgaatgtgtcccagagattctggtatgttgtgtctttgttctcgttggtttcaaagaacatctttatttctgccttcatttcgttatgtacccagtagtcattcaggagcaggttgttcagtttacatgtagttgagtggttttgagtgagtttcttaatcctgagttctagtttgattgcactgtggtctgagagacagtttgttataatttctgttcttttacatttgctgaggagagctttacttccaactatgtagtcaattttggaataggtgtggtgtggcgctgaaaagaatgtatattctgttgatttggggtggagagttctgtaaatgtctatcaggtcaccttggtgcagagctgagttcagttcctggatatccttgttaactttctgccttattgatctgtctaatgttgacagtcaggtgttaaagtctcctattattattgtgtgggagtctaagtctctttgtaggtctctaaggacttgctttatgaatctgggtgcccttgtattgggtgcatatatatttaggatagttagctcttcttgttgaattgatccctttaccattatgtaatggccttctttgtctcttttgatctttgttgttttaaagtctgttttatcagacactaggattccaacccctgcctttttttgttttccatttgctcggtagatcttcctccatccctttattttgagcctatgtgtgtctctgcacgtcagatgggtttcctgaaaacagcacactgatgggtcttgactctttatccaatttgccagtctgtggagtatttagcccatttacatttatttttaaatgtattggagtatttagcccatttacatttaaggttaatattgttatgtgtgaatttgatcctgtcattatgatgttagctggttattttgctcattagttgatgcagtttcttcctagccatgacggtctttacaatttggcatcttttgcagtggctgctactagttgttcctttccatgtttagtgcttccttcaggagctcttttagggcaggcctggtggtgacaaaatctctcagtatttgcttgtctgtaaaggattttatttctccttcacttatgaagcttagtttggcgggatatgaaattctggattgaaaattcttttctttaagaatgttgaatactggcccccactctcttctggcttgtagagtttctgtggagagatctgctgttagtctgatgggcttccctttgtgggtaacccgacctttctctctggctgcccttaacattttttccttcatttcaactttggtgaatctgacaattatgtgtcttggagttgctcttttcgatgagtatctttgtgttgttctctgtatttcccgaatttgaatattggcctgcattgctagattggggaagttctcctggataatatcctgcagagtgttttccaagttacttccattctccccgtcactttcaggttcaccaatcagatgtagatttggtcttttcacagagtcccatatttcttggaggctttgttcatttctttttattattttttctctaaacttctcttctcatttcatttcattcatttgatcttccatcactgataccctttcttccagttgattgaattggctactgatgcttgtgtattcatcaagtagtctcatcctgtggttttcagctccatcaagtcctttaaggacttctctgcactggttgctctagttagccatttgtctaattttttttcaaggtttttaacttctttgccatgggtttgaatttcctcctttagcttggagtagtttgatcatctgaagccttcttctctcaactcatcaaagtcattctccatccagctttgttccatttctggtgaggagctgcattcctttggaggaggagaggtgctctgatttttagaatttccagtttttctactctttttttttccctatctttgtggttttatctacctttggtctttgatgatggtgatgtacagatggggttttggtgtggatgtcctttctgtttgttggttttccttctaacagttaggaccctcagctgcaggtatgttggagtttgctggaggtccgctccagaccctgtttgccttggtatcagcagtggatgctgcagaacagcggatattggtgaacagcaaatgttgctgtctgattgttcctctggaagttttgtctcagaggagtacccggccatgtgaggtgtcagtctgcccctacaggagagtgcctcccatttaggctactcagttgtcagagacccactggaggaggcagtctgtcctttctcagatctgcagctgcatgctgggagaaccaatactctcttcaaggccatcagacagggacacttaagtttgcagaggtttctgcttccttttatttggctatgctttgttcccagaggtggagtctacagaagcaagcaggcatccttgagctgcagttggctccacccagttcgagcttcccagctgctttgtttacctactcaagcctcagcaatgtcgggcacccctcccccagcctcgctgccaccttgcagtttgatctcagactgctgtgctaggtatgagtggggctctgtgggcataggaccctctgagccaggcatgggatataatctcctggtgtgccgttcactaagactgttggaaaagcgcagtattatataaagagtgacctgattttccaggtgccatctgtcaccgctttctttgattagaaaagggaattccctgaccccttgcacttcctgggtgaggcaatgcctcaccctgctttggctcatgctcggtgcactgtacccactgtcctgcacccactgtctgacactccccagtgagatgaacctggtacctcagttggaaatgcagaaatcacccatcttctgtatcactcatgctgagagctgtagactggagctgttcctatttggcctagctaattattaatatttcttttcttatagtaattttggttttggtttgttcttgcttttctagtcatttgagatagatcattacattttttatatgaaacctttctccttttcttgtgtaggcatttcttgttctaaacttgtctcttaatagtgcttctgttgaatctcacagattttgctattgcatgatgtgatctttctttgttttaagcaatttcaaaattgtttcttttttatctattggttataaggaatatgttgttaaattttcatggatttttctagttttgtcttggcattgattttataatttatttcattgtgttcagataaaataatcagtaaaatttttattttttaaaatttgttgagacttgcttaatgtcctcatatatggttaattctggggatgttatatgtgctataaaaagaatcttacattctgcagctgttggttaaaatgttctgtaaatatcaactacttcaatttggtctatggtacagtttaaatctcatgttgatttattgtctaaatatctgtccaatgctgaaaaggtgatggtgacatcctcaactattattggacttaggtctatctctcctttcaggtataataatatttgcttcatatatctcagcggttcatggttggttgcatatatatttacatttttgtctttttgaacaattgattcatttattatcatattaagtctctcttttcctctcaaaattttggcttaaagtttgtgttttgctgaggtaagtgtagctatttctgcttgatttgggtttctgtttgcatagcatatctatttcatcttttcaattgcagtctatgtgtaactttattggtgagatgagtatcttttaggctgaatattgttgagtcttgttttttaatccatcaatctacgttttcagttgtgtaatttaatccacttattttcaaggtatttatttatttataggtaaaggcttattcttttatttttttctgtttattttgtatctcccttattccttaatttctctcttattacttattttgacagtttgatagttttctatactgataaagtttgattattttttctttcacctttgtctgttggctctatgagtgagttatataattttgtgtgtttttatgaagtgtattatcatcttttcaccttcagatgttagacttcctcaaatattccttttaaggctggtttaatggtaataaattctttatgtttttgcttgtttgagaaatactttattcctctgtctctgttttttttgtaggatcaaagtttgctttatataatattcttcattgacatgattataaaacaaattttatcacttagcatatattttcctattctttcctggcctataagttaatgctgagaaatccactattagctgaatgaagattcccttatagatgatgtgtcagctttcttctgccatttttagaacacctgctttgcatttgacttgataatttgacgatatgtgcatcagtgaagacctttttggattgaagtaacttggtggaactttcagcttcttggatctagatgttcatcttttgtcaataacttaagaagctttctgctattatttcattgaatataatttctatgctgtttatcttctcattctagaattttcatcatgttaattttttttcttttttacttagtgatgttgcataaattctgtaggattactttattctttttcttctttcttgtctatgtgagtcatttcaaaaacatggtaatagttggaaattatttcctctgctttgtctcttatgttcttgaagctctcaatagtatatttttaaaaaaatttgttcattgctttaaagtattttatatttttgtgggtacatagttggtggatatgcttacggggtacatgagatattttgatccaagcatgttctagtgaaaaatttttacaatgaacaattcaataaagttgcagaacatgaaattaacaagacaaaatcaataacatttctatttgcctacaatgagcagctgaaaaagaaatcaaaaaagtattcccatttacaatagtcacaaataaaattgaacatctaggaattaaaggactgaaagatctctataatgaaaactactgatgtaagaaattaacactgatgtaagaaaacactgatgtaagaaattagagggtaccaagaaatgaaaaaatattccatgttcattgattagatgaataaatattgttaacatttctatattaagcaaaacaatctactgatgcaataaaatcatgaaaataccaattacattcttcacagaaatagaaaaaaatctcaaaatgtatatgaaaccagaaaagacccagaatagtcaaaggtatcctaagcaaaagaaaccaacttggagtcacattatctgacttcatattacactacgcacctatagtaaccaaaccagcatgttactgccataaaaacagacacagagatcaatgaaacagaatagagaacccagaaaacaatctacacacctgcagtgaactcattttcatcaaagttgccattaacatacacagaaaaaaagacagtctctttaataaatggtgctgggaaaacagaatatctatatgcagaagaatgaaactagatccctagctctatccatatacaaaaatcaaataaaaatggtttaaaggcttatatctcagacctcaaattatgaactactacaagaaaacattaaagaaaatctccaggatgtttttctgggccaaaatttcttgggttataccccataatcacaggcaaagtaaaaatgaacaaatgagatcacatcaagttaatcagcttctatacagcaaaggaaacaatcaacaagtgaagagacagtccacagaatgggaaaaatatttacaaactatccatctgacaaggaattaataaccagaatatataaggggctcaaaccctctataggaaaagataaaaaaatggacaaagaatttgaatagagatgtttctcaaaagtaaacagaaaagtggcaaacagacatgtgaaaagatgctcaatatcactgatcatcagagaaagtcaaatcacaactacaatgagacatcttctcacaccatttaaagtagcttatacccaaaagacagacaaaaataaatgctgatggggatgtgaagaaaaaggaaccctatacaattttggtgggagtgaaaattagtaaagaccactatggagaacagttgacggttcctcaaaaaaatgaaaaatagagctaccatatgatccagcaatctcattgctagatatatacccaaaagaaataaatcagtatgtcaaagagatacccgcactcccatgtttgttgcactatttacaatagctaagatttagaattagcgtgaatgtccatcaacaaatgaatgaagaacatgtgttgcatagacacagtggagtaccattcagccatgaaaaagaatgagatccattcattttcaacaacatggatggaactggagctcattgtgctaagtgaaataagccaggcacagaaagacaaacatggtatgttatcacttatttgtgggatctaaaacttaattaaactaatgaacatagaaagtagaaggctgattacttgagcctgggaagggtactgggggcatgggggtaagcagggattttaacaggtatgtaaaaaggaataagacatactatttgatcacacaacagggtgactatagtcaataataacttcactgtacatttttaaataactaaaatagtgtaattatattgtgcataagacaaagtaaaaatgcttgaggggatagatactccattctccataatatgcttatttccaattgcatccctgtatcaaagtatctcatgtaccccacaaatatatacatttactaggtaaccacaaaaatttttaaaaattgaaaatttaaaaatttgaaagatatacttaatggaaaaacaagcaatttgtaatacaattattttatgtaataaacaattaggggacaggtttcaaaactattgacttggatttagtaacaacagtaagtattagcaattatcatgattgtactattagtcattctttcacttgtcctacttctctaccaactcttccgtttcctggtggcactattaatttcccttaatgtacatgggaaaattattaaaatataaagttagattgctttgaatttttattagtatttcatcaacttttatctcacgagaaagttaccatgtagaccttatataatttgcattcaacatggatattatgttttagccattgaataagattttagttgtatgttgatgctaataagaaggtaaacagaaatgatcccctaagagactgtataataatgttgcaaagaataattgctatctatatatatcttaaaagtgtgatattaatttaaaacacatgagattcttgtgttctctcataaggaatattctatagaataaataattgttattatgaactaagggcacttttcagatacaagtggtagaaattatttggtttttattaggcaagcacttttcatttttttcttggattctctgagatgcaggtatgacgttgagacataagttgccccagggagctttcctgagttgtcctgcaggcttggcataaggtggaaaaacacctgttcttatagggtaaaatgacctttttttgctgtaacatgtagacctctggaatctcagggatgaatggtttaaatgctggagtgaaagcaagtaaacactgggttttgttgcaaatattttgggggcacaatttctttttatgttgaagaatggtgtacattttaagctagaatactggtgaagagccccaatccttacaatacatcattagcatttcaccttgctcatctgtttgcaaaaacttctgcttctgcttttaaacaagtccacaggatatctgtcatctataacattgctggagaatgtaatgttgatgtgctagatgataatcagtatctattaaatgaggaatgatatctcaggtgactggcatatgataggtaattaatgttattggaaataacaaaaataaccaaaattgcaatattaatatttctggatcactgacttagtgccagacacattttaagtgttttacctgctttaacttttttccacaatacaatataaagctggcaaaagtacacataaatatctctatcaacattctggtatatttttctatcatttgctgcctgattttattaaaaaaattctaaattgtgtattctttttattctgaccctctgcagtctaattcattgaatatcttggaaactttttaaaggaaggaaatataatcagatctctccatttgttaactctttttagtagcttcccaatgccataataaatatttcaagatcctaataattatttggctccaacttgcctcttcagaatcatctgtttcttagtattcttctgcaaactaaacttgaagacttgagaactgtctttactactttgcctgcttttccttttgtgtcttcctctccccctcattcatcacctatttcttcacacctttcagttctcatcttgattatccatgtctccagtatactttctgttatcccaactggatatatccttgttattgtggtactgaagataatgcttttcacacattttattacttgcttatattttatctttcaacatagagtttaaggaatgtggggacagaaactatgtctacttttcttgtcttcttaaaatccaaagcagtggtttgtgtgaagcactttataagtattctttggttgaataactaatactttcttatatgttgcaaaatgaaggctttaatttgaacattactaggttcagatagtctctagtagtactcttttttctgtagtaataatgaaattcatataattgtgatgatatagaaataggaatctttaattggcatctggtttaccccacccactaaacatctttctttcacttcaagcaaaaacactgaaagaagaatatagtatcattcccaccaaaaatttaagacaaacaaaacaaaacaaaacaaaacaaacaggtttttttttttttttttttacctttggcagggattttgcaggtttgccgtgaagttttccaacaaagtgaacattttgtaagtgtgggtgaggaaattaaaaattcctgtagttttgaagaagctttgtttcacttttctccattatctcagataatgtagtattttttcataatgggaaaaaggaaaacaaaggcatatgacacaagataattgttatgagaatacaactgataattatctgaaaggagttagaataatgtagccaaagatatataaattgtctatgcttagataaaacaatatacatgtatttatacctggggataatttagtttttgtgcattatctattttgctcatatgtatttacaagaaagaccaagtgctaagagaattgtgggagaaaacttattcttctatcacatcagtgtattcgccatcgtaaaccataattaaaataaaccttagagaataaaacatgcatttgtttactctataaagcagcaatagtaatagatatacacttaaaacaagtctttgaggtccatgatcaatggattctactctactcataaaaaacaattttctaagaagtactcaatttttttcaaaaattaagctagtcccttgatcttttgttcttcaagtgaactgttgagtattttgtgagtatggctgaaatccttgtacctactactgctttgggttcatgctaaggtcttaataatgttagattttaagtaaacatattgtcaaatagcagctgaaattttttcagaaattattgaaatagagacttttgcctaacatggatttcactcatattgttcttagtgaagagacatagttaaaaaaaaaactatacagaagtaacttgatgttcacatttcaacagatgtttgactttaagacaaatgattttcaatcctttagtgaaggagtataaagatactagaaacttcaaattacctgcattgatttttgagtctttgatagagaaattgtatcgttcaattgtgaaggaaacattatggtactgtgggaaaatattttaatttctaaataagggacctgagatacacaattcaaaacaatcccctcaatgctaactagatagttgtgctagaaaaatgcataactcctcaatctacatgtctgcattcagcaggatgtttcttgatgtgtctaatgacttttcttaaatgaaaaatatgtcaagtaaaatggatgtgtgattgctgaaagaaatcctaatgacattaatttataggtttatgagttcctggagtgtgctgtattagtgatgaccacagggttctaacagatgctataatgtaagtctttccataatatttgtgagattgatagattattttatattttcatttcctcatttcttttattgaaaaacagtacttctctgactttatacgtacttaccttctgttttagttaattttcacactgttgacaaagacatactcaagatgggataaaaagaagtttgaaggactcacagttccacgtggctgggaaggcatcacaatcatggtggaatgcaaagagcaagccacgtcttacatggatggcagcaggcaaagagagagaacttgtgcagggaaactaccccttataaaaccatcagctattgtcagacttattcactatcatgagaacagcacaggaaagacctgcctccatgattcaattacctcttactaggaccctctcacagcacatgggaatacaagatgagatgtgggtggggacacagtcaagccatgtcattctgcccctggcccctcccaaatctcatgtccccacatttcaaaaccaatcatgccttacagacagtcctccaaagtcttaactaatttcagtattaactcagaggtccacagcccaaagtctcatctgagatgagacaagtgtcttctgcctatgaacctgtagaatcaaaagcaagttagttaattcccagatacaatgagggtaccagcattggataaatacagatatttcaaatgggagaaattggctaaaatgaaggggctacaggccccatgcatgccagaaatccaacagggcagtcattaagccttaaaattacaaaatgatcttttttgacttcatgtctcacatccaggtcacactgatgcaagaggtgggtttccatggccttgggcagctccacacctgtggctttgcagggtgcagcctccctcccagctgctttaaagggctggcattgagtgtctttagcttttccaggtgcatggtgcaagttgttggtggatctaccactcaggtgtctggaggatggtggcccttttctcacagctcctttaggcagtgtctgagaagcaactcagtgggagttccaactccacattttccttcttgaagtccctaggctacacagaatactgggacgatttttttctttctagcccaccaggcctgtgatggaaggggctgccgtgaaggcctgacatgctctgaagacatttcccccattgtcttggtgattaacatttggctcctcattacttatgcaaatttctgcagccagcttgaatttttcctcagaagaagttaactcttatggtttaatgtaaacacagtatattaaaagtctaagtatgtgcatggcaaagagacaaacaacttgctctttacttgagtctttaatgtcccttttatgtttgtaaatgctattatccaggtagtatcaataattttgcgtggatgagtcacttattttatgtaatatattttacaatagtgtcaagaacattcacagtgagaagttcctttagttctgcaatcactttgagatggaattaaagatgaaaataattatatgagtatatcagcatttcttggatattgtgcttcaaggaattttttggtaaaagttgacatataattgctatgctatacaatttactgattattttgtaaaatccattatttgtggtatattcacagaattgtacatccatgacaacaatcagtttcagagcatttttatttgtatcacaaaataaaccctgtactctttagtattttttcctcaccctgagtttctgcatttctcctgccctgctcaattgctaattaaatttgtatctatagatttgcctattctggaaattttaaaataaatataatcgtacaatatatagtttcttgtgactggcttccttcatttagcataacattttaaaggttcatttatgatgtagcatatgtaaggacttcattcctttttaatggcaaaataaacattttatatatgagcatacacattttatcgatttatttatcagttgatggacattaatttttccctatttttggctagtatgaataatgatgcttatgaacaagcttagtgtaactgtgttttcatttctgtcagatacatattcttagaagtagaattgctgtgttgtgtttccttgcatgtttagctataaaaggttaaactgtacgtgtaaacttttgagaaattgctagactgttttccaatgtggttgcaccattttccattcccatcagcaatgtgtaagtgttacaatgtctccacatcgttttcaacaaatgattatgtgtctttttattacagctaggctggtgggttgaagtagtgtcttgtggggaaaagaaagagagatcagactgttactgtgtctatgtagaaagaagtagacataagagactccattttgttctgtactaagaaaaaatcttctgccttgagatgcagttaatcgataacactagccccaaccctgtgctggcagagacacgtgctgtgttgactcaaggtttaatggatttagggctatgcagtatgtgctttgttaaacaagtgcttgaaggcaatatgtttgttagaagtcatcaccactctctaatctcaagtacccaggcacacaatacactgcggaaggccacagggacctctgcttaggaaagccaggtattgtaaaaggtttctccccatgcgatagcctgagatatggcctcgtgggaagggaaagacctgaccgtcccccagcccaacacccgtaaagggtctgtgctgaggaggattagtaaaagaggaaggcctctttgcagttgagataagaggaagtcatctgtctcctgctaatccctgggcaatggaatgtctcattgtaaaacccgattgcatgttccatttactaagataggagaaaaccaccttagggctggaggtaagacatgctggtgacaatactgctctttaatgcaccgagatgtttatgtatgtgcacatcaaagcacagcaccttttcttaaccttgtttatgacacagagacatttgttcacatgttttcctgctgaccctctccccactataaccctattgtcctgccacatccccctctcgagatagtagagataatgatcaaaaaatactgagggaactcagagaccagtgccagtgtgggtcctctgtatgctaagtgccggtccccagggcccacttttctttctctatactttgtctctctgtctctttcttttctcagtctcttggcccacctgacaagaaacacccacaggtgtggaggggctggcccccttcagtatctcattgttgattatatttccttggtgtctaatgatgttgaacattttgactttgcttataagccactgtattttttttcttttttggagaaatttctattcacatccattgcccatttttaattaatttctttttcttattaagttgtaagtcgtatttctgatacaagtacttcattagttatatcatttgaaaatagattctaagattatgtgggcttttgttttcttgatgctgtcctttgaagcacaaaagtactaaatttgataaagacctatttatatatttttcatatttgattgcttatgcttttgatgtcatatgtaagaaaccactgccaaattcaaagccatgaagattatcttctgtgtgttctttttggaattttatgattctacctcttaaatttaagcctttgacctacttttagtagttttgtaaatggcttgagaccagaagtcaaactttattcttttgtttgtgggcaatccgttattcaataagcatttgttcaagactgttcaattttttcattgaattgttttggcatctttgtaaaaaaccataaatatgtgggtatgtttctgggttctaaaatctattttgtttgtatatatgtctatttgtatgcctataccaggctcatttgattattatagatttgtagttggctttgaaagaagaaagtgtaaatcttccaactttgttattattattattattattttcagacaggatcttactctgtttcccaggctgaagtagagtggtgtgatcatggctcactgcagccttgaactcccaggctcaagcaatcctatcaccttagcctactgagttgctaggaccacaggcatgtgtcacctctcctggctaatatattattattagtattataaagacaagagtctccttatgttgcccaggctggtcttaaactcctttgctcaagtgatctacctgccttggcatcacaaagtacaactttgttctttattttaagacttttttggctatctttaggtttcttgaatatctttgtgaatttcagaattagtttgtcaatttactggaagaagccagttgggattttgatagggattgcattaaatctgtatatctatttggggagtggagtatggacactacaacaatactgtgttttaatctgtgaacatgagatgtctttccatttatttacatcttttaaatttctttcctctatgctttacagtatccataatgcaagttttacacttattttgttaaaattgattcctaatagttatattcttttggatgttatttgaagtgcaattgttttcttaatttcattttggatatttcattgcaattatgtaaagtaatttttttgtttattgatcttttatcctgaaaatttgctttgtttattgttccaatattttttctagcagattcctaaagattttctagatgtaaggtcatgtcatatgccaaaagtttaacttctttcttttcaatgtagatttatttttttcattttcttgcctttatcttgactagaagctccattaaaatattcaatatagataaagagtggatttagtctttctccattaagtatgatgttagctgtgcattttttacagataacacttaccagtttgagaaagtttccctctatccctactttacggggtactgttataatgaaggatattgaattttattaaattaatttttctgcatttattgagatgatcatgcagttttatttttctgttctaattacattttgtattatgttaatagagattttaacgttaaagcaactttgcatttttaataaaacttttacttattcagggtatataattgcttctgtatattcttacattcattttgctagcaaattttgtggatttctgagttcataatcataagatttatcgatctgtagtttttattttttgtgatatctttgtgtggttttactagaaggaattagttaaatatgttgataatgcatttttcttttctgtgatttgaaggattatttttgaggaattgttaatttttctgctttaaatgacttatagatttcaaaataaaggcatcttgacctaggcaattctttgtgggttgtattttggaccaattcagcctctctttttgttataggtctattcagatgttctgtttctttttgaatcagtttaatatattttcttgtctgtgtcttcctgtagtagaatttatgtcaaattaagttgggagtgggtgagggagcagttcatggttgaaattaataggctctcattatttttaccaggacttagtagattttcttgaataaatattgctaatattacgctttataattttaggtcaatgcctggacactttaattttttatagaaaacacaatattttaatgctaaagatgtgtttaaattgtttcttttttacaattgtgatgttctatgaagatttaaacttttgactgttaacagatgatttaaatagaaatgtagcatatgtactcagtgtacatgtgtatattcagcttgtcagcattgagttatctttcataaacttatatttatttatttgacacaaccaggtgggaggggttcccagagaaacaccagagagcctgtgcactgggaggagtgcacactggggtggagccacagaagttcatatgatttgcagtgaggaggagcccggcccctcctcttcttggatggaacctggaattcagtctgtgaggtggcaaacccaccggcaggaaaacacactctctcacttcactaagagcctctgttttgccttttcttcctttttacctaacaaaactctgcattattcaccttcaaagtccgtgtgcctaatttttcatggccatgtgacaagaaccttgcttttagttgaactaagaaaaagtcccacaacatatagatacacacacacgcacacacacacacaggcaaaaatgcaaaaacattcctcattttattttgttttacagatatggtcttttttacaaattgaaagcttattgctgccctgcattgggcaagtttaccagtgccatctttccaacaggatgtgctaactctgtcactgtggcacattttggtaaatttcacaaagttccaaacatttttattattattatatttattatgatgagttgtgataactgattgttgattttactgtagtattgtgttgcgggcaccagaaactgtattgggataatacgataaacttaactgataagtgctggtgtcttctgactgctctaccaaccagcctttcccccatttctctctctctccttaggcctctctatttcccgaggcacagcaatgttgaaatcaggcaaattagtaatcctacaaatggcctctaaatgttcaagggaaaggaaggctctgtcatctcaatatcaaaagctggaaatgattaaacttattaagaaaggcatgttgaaagctgatacaggctcagatctgtacctcttatgccaaatagttagccaagttgtgaatataaaaaaaaaatttgggaaagacattaaaagtgctacacatgtacacatgaatgatatgaaagtgcaacagccttgttggctggataaaagatcaaaccagtgacaatagtccccaaatttagacaaagcctaaaccagaacaaggccataattctctccaatgctgacaggggtgaagaagaaatctttgaatctagcagtggttggttcacgaagtttaagggaataaaccatctccataacataaaagtgcaaaataaaagaagctacagaagattatccagaagatgtagccaaaatagttactgaaagtggccacactaaacaggagatttttccttgtgtacagagcatctttctcttgaaagaagataacatttagcttttttatatcttcacaggagaagtcaatgtctagcttcaatgcttcaaaggacaggatgactctttcattagaggctaatgcagctggtggcttgaagttgaagccaatttttttttttttttgagatggagtcttgctctgtcacccaggctggagtgcagtggcaccatctcagttcagtgcaagctccacctcccaggttcatgccattctcctgcctcagcctcccgagtagctgagactacaggcaaccgccaccacgcctggctaattttttgtatttttagtagagacggggtttcactgtggtcttgatctcctgacttcatgatccacccacctcggcctcccaaagtggtgggattacaggcatgagccaccgcacccggttgaagtcactgtttatttaccatttggaatatcctagggccttagataaattattctaaatctactctctctgtgctctattaatggaatatcaaagcttggttgataacacatttctttacagcataaattactaaatattttaatcccactgttgagatctattgaccagaaagaaatattcctttagaaatattagcattcattgacaatgtacctggtcacccaagagctcttatggagatatacagggagatcaatgttgtttttatgcctggtaatacaacattcattctgtaacacatatatcaaaaagtaatttcaacttttaagtcaattaaggaataagtttcgtaagattattgctgccattaacagcaatttctctgttggacgttgtcaaagtaaattcaacactttctggaaaagtttcacctttctagatgatattaagaacatttgagtcattaaatgaagtaaacatatcaacattaacaggaatttggcagaatttgatttcaaatatcatagataatgttgagagcttcaagaattcaatggaagaagtaaccacagatatggtagaaatagtaagggaactattactggaattaaaagaagaacctgaagttgtgactgaattgctataatctcatgataaaacttgaatagatgagttctttcttatggatcagcaaaaaaatttggtatagtgagatagaacctactcctggtgaagatgctgtgaacattgttgaaatgacaacaaagtatttagaatattacttaaggttatttgataaagcagcagtagggtttaagtggattgattccaactttaaaagaagttctatcatgagtaaaatgctaccaaattgcattgcatgctgcagataaatccaagtcaaaatcacaatgagatgctaactcaagccagtcagaatggctatttttaataagtcaaaaacaacagatgctggtgagattgtggagaaaaaggaacacttttacactgttggtgagagtttaaatttgttcaaccattgtgaaagacagtgtggtgattcctgaaagacctagaggcagaaatataatttttcccagcaatcccattactaggtgtatacccaaagtaacataaattgttctattataaagacacatgcatgcatatgttcgttgtggcaatattcacaatagcaaagacatggactcaacctaaatgcccatcaatgacagactggacaaagaaaatgtggtacatattctccttggaatactatgcatccctaaaaaagaatgagatcatatcctttgcagggacatggttggagttggaggctgttattcatagcaaaataatgcagaaacagataaccaaataccacatgtcctaacttatatgtgatagctaaataatgagaagatatggatacatggggggtaaaaacacacagtggggacttttggaggtcaggggatgcgaggagggagaggatcagaaagaatagctaatggattctaggcttaatacctgggtaatgggatgatctgtgcagcaaaccacgatggcacacgtttaccttgtaacaaacctggacatcctgcacatgtaccttgaactttaaataaaagttggaaatttttaaagaaggaaggtcaatgggtgcagcaaacattatttttgtctttttaaaagacattgccacagctccccaaactttcagcagccaccaccctgattagttagcagctgtcatcatcaatgcaagaccctccacctacaaaatgattacaactcactgcaggctcagatgattgttaggatttttaaagcaatgaagtattttcattacagtgtgtacattatttgtaacatatttatattgcagacttaagagactacagtatagtgtacacataacatctatatgccatggaaaaccagaaaattttgtttgacttactttacttcagtgttctgggaccaaatctgcaatatcttggaagtatgtcttgtataagtgaacataaaatgagatctactcttttaaaagtattttaagtgtatgatacattattgttaactatggccacaatgttgtgcagcagtgctctgaaacctgctcatcttatttttactggaactttatactcattgaaaagcaactctcaatttcctccattctccagccactggtaacctccattctactctccgtttctttgagtttgactgtttcaaatttcttacacaagtagaatcatagagtatgtgtcccattgagactggcttatttcacttaaaattatttcctgaaggttcatctatgttgttacatattgcaggatgggtggatcatatggaagttctatttttaattttttgagcaacctctacactgttttcattttggctgtaaaaatttatattcacactgacagtgtatgaaagtttcaatttctccatttcctagccaacaacttttattgtgtgtgtatatatgtatgtgtgtgtttgtgtctgtatgttgataaagacatggtaagaggtatgaggtgatatctcattgcagttttgattttcctgatgatgaatttacattaattagttttcatacagctgttgtccatatgtacaacttcctcagagaaatgtctttttcaagtatttgcctatttattaatcatggctttttttctctttttgctattgagttgttgcagttcctaatatattttaggtgttaacctctcatgagatatatgatttgaaactgtttcccattcccattttatcttttcactctgttgacttctttgccctgcagaaactttttagtttgatacaattctactttcatatatttgaccttgttacctgtacttctgaggtcatacccaatagaccattgcccagcccaatgtcataaaactttttccgtgttttattgtgagagttttatagtttcagggcttatgtttaagtctttcatttgttttgtgttgatttttgtatatgacataaactaagggtccaattttattcttttgcatgtggacatctggtgttctcatgcagtaccgtttcttgaagagagtgacatttattgagtatatttgagactcattgaatataagtgcattgtatatttgtgactttatcatctgggctctctattctgttacttaaatctctctctatttatgtctttatgtgaatatcatgttattttaataactgtagcttttaatatattttgaaataaggagatgtgatgccctataactgtgttttacttttcccacattgttttggctagttacttcttcctggatcattatacattttaagatttttttgtctttgtataagtcattggtgtttcgatagagattacatttaatatgttaatcactttaggttgtatagatgtttctgtaacattaaatcttccggtcaatatactatgtctttctaaattagtataatctttaatttcattcatcagtgttttgtagtttttagtatacatgtctttcttccacttgttacagtttattcttatgtattttgtcctttttgaggccattgcaaattggagtgttttgttaatttccttttctgatagttctttgttaatacacagaaaggtaagtgatttttgtatgctgattttatatgctgcaaatttactgaatttatgcacttgttctaataatatttggtggcatctttagggttttccacatataatatcatgtcctctgcaaacagaggttattttactgttgattcagaagcctgttgctttttttctttttcttgcctaattgttccggctaggatttccagtatggtgtataatagaagcagcaagagtgaacatcctttccttattgtgaaaacagatgaaaagttttcagtttttttttaatcattgagtatgatgttagctatgagcttttcatatattgcctttatcaggttaagataatttccttctatttcttgttgcaggaagtcagggaccctgaatggagggactggctggagctgaggcagaacatcataaattgtgaagatttcatggacatttatctgttccaaaaattaatacttttataatttcttatgcctgtctttactgcaatctctgaacataaattgtgaagatttcatggacatttatcacttccctaataatactattataatttcttatgcttgtctttactttaatctcttaatcctgttgtcttcataagttgagaatgtatgtcacctcaggaccactattgtacaaattggttgtagaacatgtgtgtttgaacaatatgacatctgtttgtaaaacatatatgtttgaacaatatgaaatcagtgtaccctgaaaaacaacagaataacagcaattttcagggaacaagggaagataaccataaggtctgactgcctgaggggttgggcagaataagccatatgtttcttcttgcagaaagcctataaatggatgtgcaaggaggagaaataccgctgaattcttttcccagcaaggagtaaccctggggaaggaatgcattcctggggagaggtctatgaatggccactctgggagtgtctgtcttatgcggttgagaaaaggactgaaatatgccctggtctcctgcagtaccctcaggcttactaggattgggaaattccagcctggtaaattctagctagactagttctctgctctcaaaccctgtttcctgttaagatgtttataaaaacaatatgggaacagcaggacatagagcctcatcagtaattctaattctgcctttgccttgtgatctatatggccctttgaagcatgtgatccttgtgacctactccctgtttatacaccccctcctcttttaaaatccctaataaaaacttgctggttttgcagctcagggtcgtctgcacagtcctaccaatatgcgatgtcaaccctggaggcccagctgtaaaatttctctctttttactcttactctttatttctcagaccagtcaccaattagggaaaatagaaaagacctacattgaaatattgggggcttgttcccccgatatcatttctatttctagtttgtttagagctctcttttaaaaactcataaacaattgatttttttcaaatgctttgttttgcatttactgatatatcaagtgatttttatgcatcattgggttaaggtgatatgtcacatttgctcatttttgtgtgttctattatccttaaatctagggataaatttgtcatttcttttaggaaagaagcaatgctgagtcttgaacatagtaaaagccaagcaacactactggtcttgtaatatcaaaaggaagagtgagactttcttcacaatttaattattgagtagtttctttgcaacagtaaaaacaacaaaattctgctgaaaatgaaaccaaagaattctgagtatttgcaaaatggtattaatattgtgaacggatgtcttaatattgggtcaatgtataaagtgtgaaacacagctcagtaatttttgtgcatgtgccacttgtgaatagaataatgtatttcacataaacccatatggttttacattattttttatttttccttgtttttaagtatttgactaagaatatttctaacttttaaataggtactaaatctctggaaaataaattttgacctaacagtgtaagttataaaaatatgttttgtcacaggaggaaggaaatcctctgtatcaacctcttcatgctggaattaactgaaggaattctatcttttggtcattccagcttcaagccttttatgtaactaatcccttttctccttctttcctgttttagcaaactttcagaaagaaaacaggcaacatcttgtgatgatgaagatcacagttgacacataggccagcaggaacctaatcacatgcaagttgtggtattggaaccaggtgaggtcgtgggctgcaacccgaaggtgcttggctcctttgtgctgcatgacaaactcaatccagaaggctgcttgatccaggggcttaattggcaaatcatggcgaattattgataacttcatagcattctctttgtagctgaaggataaacataaaaataccaacattgaaagtaaatttatttcctaagtctatggatggtctttgaaaagtgtcacatcaatgcttcaaagtaaatattatagaattgtcataggaatcgaatgttttggtttggacaaatgtagaaagtttattttttaaaatggaattttataaagaaaaatatgtcttaaattaaaaatggaaggtctgatgagaaagttaatgtctttgtagcagaggaaatattttgagccattctatgtgctacaggtaagacagtggaaatgcaatctgagattgatcatcttgatattttattttatttttttttgagaaagagtctttctctacggcccagattggagtgcagtggcatgattatgggtcacagcagcctccacagtgtgggcttaaacaatcctcccacctctgcctcctgagtagctgggactgcaggcatgcaccactttgcccagtaatttttaaatatttttttgtagagatggagtcctaccagtttgcccaggatggtttcaaactcttgggctcaagtgatccttttgctttagccttccaaatttctgggactacaggtgtgaactacctttatcgacccattttgatatttttaaggaaaaattgtttcacagctggtgtaatatttctaaattagtctttctctttctaccctactattctgtgttctaccatattttcctctcagtagtcagaataattttttgaaataaaagccagattatggcattcctctgataagattttcacctggcttctcactatattaagaataaaatctaaatctgtctttgttctacagaaccctacatggtcaggcatgggcaacttcttctaacactttccccaaccaccttctctcctagaggcattgcccttctattgttctttgagctccccaatgtgttctcacctgagcccctttacaccctttatcccctctctccctctcttggaatattcctccttgcaacaacttgaggcttgcttctatatctttttgaggcttccccttaaataatacctgttaaagaggcttttcgtggccacactatggtagtacctgtaggatttcctctattgttttgtgcttattttgctgtttaactcctggaacttaaaaatatgttacatgtcttctcaaataaaactttaagtataaaatacataaatgtacacaaattcagtgaatagctcaaaattttaacattaccttgaacaatatcctgatgtgaacaccaacttacctactacgcagattataatataagacatcacaacctgcctagaaaaactctgtcttcttgggccattttagtcactacttttgtcctcaagttaaaactaccttgacttctaatagattaatattgcttgtttacataatgaattatataatatatactcatttgtgtctttttttgggtagaagttattggctaattccattgctgtaatatgattcagtcaattgacaaataccacagattatctcctatttttatgactgatggatatttgggttgttaagatttttgaacactattactaattctggggtaagcaaatgtgtgtatatcattagatatacatattaatacatttttgatgggtatatacttgagagatgagttgctgagaaaaagatgcatgtagaattatgatgttttgttgactagctttttaaatacacaaatttaatttccaaaatttagagttgttttttaagttataattttttggataatttcgaatttatttctagtatggctagagcatttcctttttatgcttttgaatcttatcacatttgctaagtcctgatttttggcccagcagaagttcaattcactaactattccatatactcttaataaacgtatattctcaatatacattcacactcacctccacacctccacacataaaaatgtgtgtgtatatatatatatatacacacatatacacaaacttactatatatatacacaatacatatatatgtatacacacacatatatacaataggttatatttatgctcttcaaatgtttatttttaagtcacttttttttctctgtttaaatttagtatgagttctagtagattcacttttaaatctactatcttattctgtattttattttctgttttccaatctgctgtatgtttcttttctaattctttcctgtttgcttttaaactatttttaatcattcactgtcttattatcttcctggtaaggtattttcagtatattttctaaggtggtacctccttatatatattgataatagtaatcaatagtcacagcattttctacattatttcttttggagcacagaaaaattattacagatttattttctcaatattaaaactttgtgcttcaagggacatcttcaataaagtaaaaaaaaagaatcaacctataaagagtgggagaaaatatttaaaaatcatagactgacaaggcattccaccaataatataaaaataattcttatgaatcaataataagataaaaatgttagaaatgttcaaaagataggaataaaattttctcaaaagaagacgaatgacttgccagtaagtgcatgaaaagatggttatgtctttagccacaaggaaaatgcaaattaaatccacaatgaaagatcattttatatccactgggatccctgtaacaaaaagataggagataacaagtgtagggaagagcatgaagaaattggaaccctcctgtacagctagaagtaacgaaaaacggtgcaagtactttgaaaaacagtttagcagttcttcataaacatcaactttccatatggctcagaaattccactcctagtatcttctcaaaattagtgaaaacaacttttttcacaaaaaatatgtatagcagtgtttataagagctaaaattggaaataactgaaatgtctgagagctgataaatgggtaaattcaaaatggtacattcatcaaagaatattagcaataaaaagaaaaaatgttctgacactttcaacaatatgggtgaaactaataaaagacattgtactaagtcaaagaaatcatttatagaacactgtaaattgtatgatttaatttacatgaaatatccagagagaataatctattgagaaagtaagttgatatttccctaggactggaggtttatcaacagtgattttatgcattttgaggtttattttagggtgataaaaatgttcaaaaattatattatggtgatggctttgtaactatgtaaatgtactaactacttttagatctcacttttaaataggtaaatattatgctatgcaaattgtatcttaaaataatgataatactaaaaatacattattgagcatgaatacagttatactttcagaaattttatgtattgaattgaaatactttattttatttctccaagttcattatttcattgtattataatccatcattcaaaaaacttatattttaaacaattatctatatatgtttaaaaatatttgtgtgtagaaggttgttacagtaattggtgacccattaaatatatgggatcaaatgtaactaaaataattggtgaaaaataaaagcaggtttcaagttggttaaattatttaaattctttcaaaattggtctcctaaaaggggtaagacatgtattcagtgttgtcaaaagaatctgtaaataccacatagtaaaaaaaattgtcatactcacacagggtcattaatgactgtcttcagtgcattgagcaaatctgtacttgacatggtcctgatgtccacattgagggccttcatgtgagcaatgttatcaggttgatctgcaaacaaaggaatgcccaccatagggatcccatggtagattgcctcatagatgccactggtttcaccatgagtcataaaagatttagtttttggatgacctaggattggataaattttagcaaaattattcataagactaaaatgagaaatgcacaatagaatgctctgaaaggggcagtgtctactaaataacagattattatacacatcaaactccattagaattgctttcggatttcagagaaagaagcacctaattcttctggaggtaagtgaaggctacatgaagaggtgggggcgtgtgtgacttcagactcaaaaaatgaattgatattgccaggtggacaaaatgaaaaagcacattctgaatgaaaaaaatgtgcaaaaaaaaagagaaaagaaaatcaataatattgtgtatgttagagcattttcccttaaatacatactgcggtctgagtgggatatgtggtgtatgcaaggcaacagggagtgtggtggtggtattggaatagaagaaaggcaggccacattacatcaggaaacgtgttatcactttatgataaagattgaggatttaggccgggtgcggaggctcatgcctataatcccagcactttgagaggcagaggtgggtggatcacctgaggtcaggagttcgagaccagcctggccaacatggtgaaacctggtctctactaaaaatacaaaaattagagaggcttggtggcaggtgcctgtaatcccagctactcgggaagctgaggcaggagaatcgcttgaacctgggaggtgaaggttgcagtgagccaaggtcatgccaatgcactccagcctggggacaagagtgagacttcatctcaaaaaaaaaaaaagattgaggatttattttcagaaaatgcagagttattggtaataaaagaggcactgttattttttagtgtcttttgaaattaaccctgaagtagggaaaaggacaggtgtaaagctgtacaaataggagacagagagacaatccaggaagttattgggaaaccccgtgagaggtaattatatctgaaataaagataatttgattctgaacataaagaatgtgagtgtctataataaaataccaactatatagttattttcctggtaagactggaaaataaatataaagtagttagcctttatatttgagttttttgataataaatgttccgtaagtttctttcaggttgagctatccttctaattagctgttagtcatatattcagtatttgttctgcagagtattaccaagaaggtcattctgggatatccacttgtacagctgagtattggatgctaaagtatttggtctctttccatccacagaacctgttggggtaaagaaaatatcttgttccatgagtagaatgccaaagctataagatgttagaactctaaagaaattgtcaatcaactagttaaaccccttccatataatagatgaaaaaacgagaacaagcaattttaggaaatgagtactactaaaagactattgaatatccacatttcatgtcttttattatcaatttggtatattagaaaatcatgatgttttcaacagagaagcttagacacttgagagtatcaataaaaaattcaaaaatttaagaaattattagacagtcattataattctactgtaaaatacagtaacaaattagtgacaacctatacatttattttatgtattttatactacctgtaatcttccaaatttaatgttagtttatttcttgagtgaaatgagaagtgttacttatatatatttttctgtaagttattttgttagtgtttgacatctttgatttataaaaaacaaaatctataaaatcagctacctgtgagaaataaatcagtgctacataggtagtacatataacttcttgtagattacacattacccagcactacatccaagaaaaatttcaagtgacaatttctttcttttcttttcttttttcttttctttctttttttttttttttttttgagatggagtcttgctctgttgcccaggctggagtgcagtggcaccatctcagctcactgcaaccctcgcctcctgggttcaagcgatttttctgcctcagcctcccaagtagctgggattacaggcatgcactgccatgcccagctaatttttatattttttagtagagacggggtttcaccatgttggccgggctggtctcgaactcctgacctcaagtgatctgcccacctaggcatcccaaagtgcaagtggcaatttctgagtcaaattcaaagtactatcattttgctagttttggaaattcttccaatgtaggcgaaaagagccaattggcaatttatgaataagaatatacacactaaaaattgtaaaattatattttgctaaattttgcttaactgatcattaacacttagatgctgctataaagcatcgacagcatagattaatatgggctgctttagccaagccatacccatagacagtaccaaaataagatactgattttagattccccaagcaatccttataaactggagtgtaatttacaagtgttttccttgtatttgctatgtgagtgttaaagtaactttgtgtttccagaaaaaaattagcataggtcattaggagaaggctatgtcagagaggaaactaaaaagtaactcacaaatacacaaagacttcaagtgtattctgcatactacaaaataagttcctactatatttcatggagtgagggcatctgaacctctttccatgcctggcttccttctgcttgactccttcttatattcccttctccttcctccgttgggaggaggtgtttttctgatggttagagcagaggctttatgggaccacattttataatgcacggagtctaccctaaaagcaggattctgttccttccttttctatcatattttcctgtttaagacattagcaaggcccagtaaacagggcaggcaagttcttctgcttctctaaatctacttggctaggtggatacctccagaatagcggtttgtcagcctggacatcttttctctgaatgcattctgaattgcctactaaataggtctattccaaaatgtacaggaagtacaggagaccagattacctagcaagcctaaattgaatgatgcatttcagacttttttcaataccttattgttattgtaatagtgcagtaactgattaaaatgtaagtgattttaaataatatctatagtgtataccatgttctcaggaaacttgtaagcaaaagggacaaatgacagggcagaatttggtgatttctatgtacatgcctacaatactatgataataccacaacttcacctgcacctcttaaatatattttttctgatcacaatattaatgtcagaatttttatcaatcaaacacaccctcgttattttagtatcttccatatatatttttgtttttgaaccaatatctgagataattagagctatcatatcagttagtttttctggcagaaaatttctgtgattggactctttacagagtttaacagactcattcagtagctgtccaccattaagacattttatctaacctttcgtggaatctgggcaagagctgatgcaatcacgttggccctttcttctgtgatgttactgaccatagacttaagcaagactgccacgacaccattttctccagagctctgcacaaactcttccattttctgtgaagaatttgttctatcacaaaagagtgtcagcatagcaaacactatagaaaagattagtacatacatctaagaagagaaaatcaagcattatcagaaatttttggagtaatggctattttttaactgacctaatctctttctttggaagaagttatggaatatgatatacatggcatctgttatggctatttgtgtaaatatgtgtgtctgtaaaaggaaaagatgaaaaacaactatgacactatagaagaaggagacaatgctagaaaatattatacccagactcttcatttacaatactgtaattactaatatgggttcttggaaggtggcatttgttgtgtttaattccatatgttgtagttctactaaattccttgtgtctattaaggcagggttttttgtttgtttgtttgtttgttctttctgtagagtatttttagttgggagtcattggaaccattacctggctatgagcagtgaggaaaagttactattgaaataattttatatgtctatttctttagctctgtaattctttatacctcatttaaaacttgtcagattatgtctttttccctaaaaaaaaatctttaaaagctgaagtttaataatgatggagattcaagagtctgatactgtggtgtgaaatttctgtgaactagtcctgagaatcccatttataatacagaattatgcagtatatagttacataactgagtgattgtatttctcaggtcattgtttaaatattactaagacactttttttcctgaaatcacactgcataaaatgatatgctactggccaggcatggtggctcacacctgtaatcctagcactttgggaggtcgagatgggcagatcaccaggtcaagagattgggaccatcctggccaacatggtgaaactctgtctctactaaaaatacaaaaattagctgggcgtggtggcacacacctgtaatcccagatactcgggaggctgcggcaggagaattgcttgaacccgggaggtggaggttgcagtgagccgagattgtgccgctgcactccagcctgggcgacccagcgagactccatctcaaaacaaaacaaaacaaaacaaacaaaccaaacaaacaactgatgtgctacctataactgcctgtgagggaccctcatcatcacttttctgtgtctcacaggggcacttaatcctcagtggaagaatctaccagtcatttttccagtggagatctcttcactatcttgagtagctcattcacacaatataaagcccttgttgaatatgtgtttgcttgaaatttattgagaattactctgaattgtggtttcccttatgttctcatttgtaaatgtaaatgcatagtgtaattccacattgctcagtgcatacgcctatcaagacaaaataaagagaaagagaaatgtagcgccaaaagttttcagtatataatgtcaaaattgaatacccatctttttgttgttgttgtttcttttgttttccatttattatttatttattttctctgtaaaataatgatgaacccattctgacataaccggtatactttcagatcctaaacatgggaggtaaactttcttttaaaaacttgtttaaaaaaagaaatcctaaagtttgtgtatgcacaacatattttgccaagtatttttcaaaaatataatttgagccttatgacattagttttaattggagagtcactgtactactattccaggtagttcttggggctcccaggtattctgtgtgactcgttacctgtgtgaacacaaagtatctgaaacagttctcaatttagaaagtttattttgccaaggataaggacatgctcatgacactgcctcagaaagtctcaatgacacgtgctcaaggtggttggggcacagcttggttttacacattttagcagacatgagacatcaatcaatatgcgtatgacgtacattggtttggtcaggaaaggtggggcaattcaaagtgatgccttcatgtcatagataagagttaaaaggttgcattcttttttgggtcttagatgagccttttgctgaatacacagtatacatatgagagaagggttgagaaatagtcacttatgccttagtctgactcagtaaatctgcattttttccataaacaatggtgaagggatggctttgagttctgtcctcttttgtccctcacctgtgaagataagctatcaatttacatttccagggtgaaattcaacagaaatgtttcaggttaaagattttgaggcccacaaggaatttcctcttgggaagattgtaagggaggtatgtaacttaaaaacaacaacaacaacaacaacaacaaaaacccaactttgtagctattttatttaggaataaaatgggaggcaggtttggctgatacagtttccagcttgacttccctttgacttagtgactttgggttttcaagattatttttctttcagacctgtagccacatttaatggaacttgtgtttgatgttttttctcaatgcctcgctgcccagagtcttcttcatccacccaatattgaggtagcatattgtctgtttatacactcatcagtgatctcattctgggatatcttcatgaaaataatatatcagtgtacaaaatattagagtatgaaaagcttaaaaaaattaaatttccctcatactctctgtctagagctattcctgatttaaatttgtatgcttttattatggtttttattctatttatataattcactgtgatgtttatttagataattttaatcttattgtatattccttttcatcctgcataaaaattgtgatctagttctattcatcattttgtttctcagtttccgacaattcttgtattatagctgacactgtaattatacatattttgataaaatgattgtaatggcatagaatgcatattgtatacatttttacatagtacccaatagtttttcaggccttctgcccttctcttccctctgtagtagtccccactgtctattgttcccatttttgtctatgtgtgccccaagcttagctcccacttttaagtgagaacacatagtatttagttttctgtttctgggttaattattctggttcatgtgtgtgtgtgtgtgcacaaatctccatgtatttgtttgtttatcttggctttaatctgtcattttattttcttttttcaaatgttgtctgcctatctatctatatatttatctatctaatctatctatctatctatctattatctatttatcatctatctatatatttaagaatgaggacatagaatgattcactgggatatctttgtatctgtgaaggacttagtatctggttggctttgatttttatgctgaacgcgtacaactactagaccttacctaaagggaaccaaaaatttcataaaaaagattatactttgatgtgttacatcaattctagttttctcattttaccctggtgaatttatttcaatttctttaaggaaaaactctctagtttttgtgtggaaagtgcaaagaggaacgtattatgtaatacagtaagggttagtgcatttcattttcatgtctttagtttcctttagtctgtaattatcccttcattttttgtctctgttaatttttgacttctagatgaattattgaccagttgttttgtagaatgattcttattttacatttgtttaatgttccttcatgattaagttgctatcacacattttttgaaagaatactgcagacatgttgttgtagtcttcacattacatcatttttgggcagcagatagtgttgatttgtcatgctggtgatactaactttgatttcttggttaagatgctgtctacaggtttattccctgtaaaattataatttctcattttggaattagaagtatcttgataggagactttgagactgtaaatatcctgtttccattacatcctttccctctaattttagcatccattcaaagataatttttgcctgaattaaattactgtggagtttgtctaatgattatttctatgtctataatttctttaacaattagtaagagaaattctactctaagaaagaacattttttcccttttatttccttatactggtttctgtcaatatgatttcatgagtatttggtttattccaaaggttacaatccacagctatcattattccattgctcaaattggtccagattcgattcattgggacttccttcagtttccctctatatttttctgatatgttgtcatcatgttgtatacttatttactttctggcacccctagatatttcaggcacatcctgtacttttgttgcctcaggggtaatgtcatttatatcttgaggaaggcatggttcgttttattggagtatagtgtctagaagcaaaatttcaagtacttagcatgttcattgcatctgggatattattacttctaggccatttacgcatagacattttggaaatgtatctatgcataacttttcattaacagcttaagagaataaataaattatcatttccataaaatacagaaaaaggagagtgtagtaagctaaaacatggtaaatctaaatagtaaatatttacagataagctcaaactaataatttaatgtaaaaagttattttcatttaatgtcatgtaatagttatatatcaatttaaaaaagaattaaataaactcacccattatggtagagattctcagatatttcaatctagcttttatttttgtttaaaagagaaacacctaataaaaattacccatattactataaaatatatacagattttacaagaggcatatacccaatagcaaataaatgaaaattgatgcaatgctacaaaaatcaaacaaagcagaattaagatgcgaagtatcaaatgtgataagtgaatcatttcatgtggatagaaataattcacttaaaattaacaataataagtatttggagattgaaatatatctcagaaactgatagattgaacagagaaaataaattctatgaaagttgattgtattagcaacaaaagtaacaaaaataacgtactgaatcctgcatcttcaaatagagtataaatattcttttgaagtgcacatgaaaacttttataaaattaaactaaggcaatgtcacagatgaaatctccacaaattctgaagtatatatatcatatgtatctatataatgtgatacaattaaaataattataaacttaaagagaatgtattacctttcaaatatacacatttaagaatttcattcagtggagtggactgtgcttaccattcatgacccaagtctttactaccttttctgctccaaacacatataccatgaagagaagacggcatagaatatactcaggtaagtatacaactgagaaaacttacacaccagttgttagcattagagaaaattatatgaatagattcttataggagctataacaagatggttttggcaggataaaaaatgtggcaaaagccttaaaagtggaaaacaaaatttacctacggagttcagggaatttctgttctgaaaaaatgtaagttgtaataactaaaaaattaaaacaaattataatgaaactgatctctctagatgacagcagacacatgcaggaaatgaaagtttgcagaaattaacagctgttgaagattaactcatgaaaaccacatgaggaaataaccaattctacacaatagtaagattttcacccaaagtttataaatataggaaaaaatcaaaataattttttttctcagagatgagaaaatacttaacataaaaatggaattgggtgagaagcatgaatagaaagaggaacatttagaaattgtggaaattagaaatacagtcactgattgtataaaatgtaatagagttcacaaaataaaatggaaccgaatgaacgaataaaagaatgaacaaaacctgcaataaggtgaattagtaaactttctctttttctgactgaaccttgactgatagagcttccaacagaaatcacctaatactgtaggaattgccattaagctgattaaaatatgaaagtgttatttgctattaccacatgttagagccctcctgattgcctgctttacttctgaagctctgtcattatggtttcctggttttaatcactcattctatgcttcactgaaatattttgaactgattcaatgtgtttctctcaaatttaattttattctatcctgtctcttgcctcctgcaggttctcactgtgagcaatccagctccagagcttaccttctctgacctagggttcctcatttttttttttttaccagtttatctgaacttcattgatcttgttcctttgccaatcactctgagccactgtcatcatgactcaggattctagaatttgaacaaattataaatttgccctttgtatcttctgtatcccaaagaagaaccagtagacggtaccacaagagaaaaatgagtgcagtacatgaacaaaacacctgaatgaatcacaaacaaaaagagatggttgattagatttataattaagcatttgccaatcaaatcagtgattcatttttatattatttggattggtaaaatttaacatccaccatagatgaagcacgaaataactgtccactccagtgctgcataggtgggtgtacatagagggaggtagtgtttgaaggatacccctgggctcaactgactcaagctagctcagtcttggtaagagggagactggacacttctggtacagttgggctgcagacacactgtaccaactgtaagttcactttggtgagaatcttcatatgccctcacttgaaagaattttcttttccagataagtttatgccttttattcatccgaattttaccatgatgctgtgctcaaagatacaacaacatttgaggcactaaaaaatgaaaaattttaaatattgttgtctgctctaacagttttcaatttactgaaggtggaaattttacagttattaagaaataaagtaaactgaaaaaacataggtggagtgagactgagagaaaaagaaatggagagagtcatggaactcttcccagcagggtgaaaattattggatatttattaagaaaagggatgaatgaaatgaaaattaacatggctaaaaaaaggtctcaacacaacattatgagaggtaaggtggtcaaatgagactttttgaaattaatccaacctaaaagggccccaaactaatcagtttcatttatcgcagtgtggagtagtttaaaaagcaggaatgcagagatcacagttagaaagctgcttaataatttcttcagataatgctgaggcagattaatcaagataaaaattaacacacaaaaaaagggtttattggtttaaggccctgctgttgacccaaagccttgtgtaagactgtcaggggatagggaacagaaattccagagactccttaatacaagaccccatgtgatatgctaccaagatgcattggggaagccttgaccgaggttatagttaggttgagaaaccataaaaatataaagattaatagaattatgaaatttgtgatatttaaacaggcttaatttaaagaaagtgtgtctttttaacttaaatgtcttatgaaatggactttatgtctggctggaaacacttgttctgcctattgataatattgtaacacaaaacctgctgataaagtcctaaaggagcttaagtaaaggttaatgaaatgaaaaggaaaatgtataggaaagttggtatttttgaacatactttatgtgaagtagtatctattttatctgaatgtgtcaaggttgaaggacactgtatctaactaggaaatgtttcttgaatctaatattgtataacagaaggtatgcaaatttgcccttcagccaacattaattggacatgctaaatgaaaaccactatggtagggtggagtcaagatggccgaataggaatagctccagtctacagctcccagcatgagcgacacagaagacgaatgatttctgcatttccaactgaggtaccaggtgtatctcgctgaggattgttggacagtgggtgcaggacagtgggtgcagtgcactgagcatgagccaaagcagggcgaggcatctcctcatctgggaagtgcaaggggtcagggaattccttttactaaccaaggaaagggtgacagatggcacctggaaaatctggtcacttccaccctaatactgtgcttttccgatggtcttagcaaatggcacaccaggaggttatatcccacacctggctcagaaggtcctacacccacggagtctcgctcattgctagcaaagcagtctgagatcaaactgcaaggtggcagcgaggctgggggaggggctcccacaattgccttttgtttggctatgccctgaccccagaggtggactctacagaggcaggcaggcctccttgagctgtggtgggctccacccagttcgaacttcccagccactttgtttactcaaaaccgctcaactatatggaaactgaacaacctgctcctgaatgactactgggtacataacaaagtgaaggcagaaataaagatgttctttgaaaccaatgagaacaaagacacaacataccagaatctctgggacacattcaaagcagtgtgtagagggaaatttgtagcactatataccctcaaaagaaagcaggaaagatctaaaactgacaacctaacatcataattaaaagaactagagaagcaagagcaaacacattcaaaagctagcagaaggcaaaaataactaagatcagaatggagctgaaggagatagagacacaaaaaacccttcaaaaaatcaatgaatccaggaactggttttatgaaagaatcaacaaaattaggagactgctagcaagactaataaagaagaaaagggagaagaatcaaatagatacaataaaaaatgataaaggggatatcaccaccgatcccacagaaatacaaactgccatcagagaatactataaacacctctatgcaaataaactagaaaatctggaagaaatagataaattcctcgacacaaacactctcccaagactaaaccaggaagaagttgaatgtcttaataggccaataagaggctctgaaattgaggcaataattaatagcttaccaaccaaaaaaagtccaggatcagacggattcacagcaaggacttcatgtctaaaacaccaaaagcaatggcaacaaaagccaaaattgacaaatgggatcttattaaactaaagagcttctgcacagcaaaagaaactaccgtcggagtgaacaggcaacctacagaatgggagaaaatttttgcattctacttatctgacaaagggctaatatccagaatctacaatgaactcaaacaaatttacaagaaaaaaacaaccccatcaaaaagtgggcgaaggatatgaacagacacttctcaaaagaagacatttatgcagccaacagacacatgaaaaaatgctcatcatcactggccatcagagaaatgcaaatcaaaaccacaatgagataccatctcacaccagttagaatggcaatcattaaaaattcaggaaacaacaggtgctgaagagggtgtggagaaataggaacacttttacactgttggtgggactgtaaactagttcaaccattgtggaagtcagtgtggtgattcctcagggttctagaactaggaataccatttgacccagccatcccattactgggtatatacccaaagaactttgaaacatgctgctataaagacacatgcacatgtctgtttatagtggcactattcacaatagcaaagacttggaaccaacccaaatgtccaataatgatagattggattaagaaaatgtgtcacatatacaccatggaatactatgcagccataaaaaatgatgagttcctgtcctttgtagggacatggatgaagctggaaaccatcattctcagcaagctatcacaaggaaaaaaaaccaaacaccgcatgttctcactcataggtgggaatagaacaatgagaacacatggatacaggaaggggaacatcacacactggggcctgttgtggggtgggggcagtggggagggatagcattaggagatatacctaatgttaaatgatgagttaatgggtgcagcacactaacatgacacatgtatacatatgtaacaaacctgcacattgtgtacatgtaccctaaaacttcaagaataaaaaaaaaagagtttttcaggatgatggtccatcctgaagtacataggaaaaaaaaaaaaaaggaaaccactatggtattccaagttcatacaatgtagaatagaagctggagtgttagtacagaaagcattatctgttcgatagcccggataaacaacttcaggaaagtttcaggatgcaaaatcaatgtgcaagaatcactagcagtcctatataccaacaaaatccaagtcaagagccaaatcaggaacacaatcccattcacaactgccacaaaaaataaaataaaatgtctagaaatacagtttaccagggatgtaaaatatctttacaaggatcactacaaaccactgctcaagaaatcagagatgatacaaacaaatggaaaaaaaatccatgctcatgggtaggaagaatcagtatcattaaaatggttatactgcccaaagcaatttgtagatttcatgctattcttatcaaactgtcaatgacatttttcaaagaattagaaaaatgtattttaaaattcatatggaaccaaaaataaaaagcccaaatagccaaggcaattgtaagcaaaaagaatgaagctggaggtatcatattacctgatttcaaactatgctacagggccacagtaaccaaaacagcatgatactagtataaaaacagatacgtggatcaatgggacagaatagagaactcagaaataaggtcgcatacctacaactgtctgatctttaacaaagctgacaaaaaaaatggggaaaggacaccctatttaataaatggtgttgggataactggctagccctacgcagaagattgaaactggaccccttccttacacaatatacaaaaattaactcaagatggactaaagacttaaatgtaaaactcaacactataaaaaccgtggaagacaacctaggcaataccattttgtgcataggaacttgtaaagatttcatgataaaaacaccaaaagcaactgcaacaaaagaaaataaaaatgacaaacagtatctaagtaaacttaagagtttctgcatagcaaaataaaatattaacagagtaaacaaacatactaaagaatgggagaaaatttttgcaaactatgcatctgacaaaggtctaatatctagcatctacaaggaactaaaacacattttcaagaaaaaaaacattaaaaagtgagcaaaggtcatgaacagacacttttcaaaggaagtcatacatgcaaccaacaatcacatgaaaaaaagctcaacataactgatcattagatgtagatgatgggttgatgggtgcagcaaaccatcacagcacgtatatacctacgtaacaaaccggcatgttcttcacatgtgtcccagaacttgaagtataataaaaaagttaattaattaaaaaaagaaaaatgtaaatcaaaaccacaatgagataccatctcacaccagagtggctgttcttaaaaagtcaaaaaattaccgatgttgatgaagtcgtggaggaaaggaaacacttgtacactctaagagtgtaaattagttcaatcaagaccagactaaatatagatatgcatccagaaatgcttttagaaaatatatcatatgtttataatacataagctaataaaatgggagagttctctgattcccctggcaggatgtgtgacaggggtgtggctcacctgtttggtcacccggcagctcaaacccctaaggcagatgggcaggtgcagaggccaggcaggtgcagaggccagggcagagcgttttggactctcagccccatggcagcgtctagggctgggtgcctacaaccacagtgttactaagctctgtcagctttgccatctgcaggcggcttgtgtgttagttagcccaataaaccctctgccttatctcaagggcagaaggccagtgtgacagtcttatgtatcctgagttcttgcccagtgtcccaaaagaatcggatcacacgtgagcgtgaaggattgaatgcaaggttttgttgttgttgttgttgttttctttcgttttgtttttgttttttagagacggagcctcactctgtagcccaagctggagtgcagtggcgccgtcttggctcactgcaaccttcacctctggggctcaagagtgaatgcaaggttttattgagtggtgcaggtggctctcagcgagatggataggtagcagaaggagggatagactgggaaggtggtcttcccctgcagtcgggctgcccagaggcaggactctgctctgaccgccgccagctccccaccaccccacctctccgctgaactatcctaagcatctagagaggtccctcctcttctctatttctctgccacatcgttctgccgttgctagtctgcttgtcggctggtcgtctggccttgatgttcagctgcttgtgtgtgtgcctgctaaggtctcaggtttatgtgggcacagaatggggggcgtggtaagccagagaggtcttggaaaatgcaacattcaggctcaaaaacaggagtgcctgttctcaattaggtctgtgggcacatgcccgagggtgaatccctcaccagtgaccttgctcttctctaccccacacttcgctgcccaatctccagttccactaatatatctaaaagtcacatgggatccctccagtctagattattggtgagactactgaaagcttcaggtacaactttaacatctgcttaccttgtttttttttctcttaaacagctttagtaatgtataattgatgtactataaattctacctatttaaagtgtacagttgataagttttgacatgtaaacattcatgaaaccattactacaatcaagataataatagatcaattgccgcaacagttttatcatgttcctttgtaattgtcttatacttctccccagtctcctatagccaggtaaccattcatctgttttctgttaatagagctttgcttgcatgttatagagtttcatataaatggaaccacagtctgtatacttgtttcactagcatctttcactcagcatcattatttttattttgagatttatttactcttcatgtaccaatggttcattccttcatagtgcggagaaatacctcattgtatagatatgctacaatttttttattcattctctgttgatggacatttaaattgtttccaatttgaggtcattgcaaataaaattacgatgaacatttgtgtaaaatctttaaatggatatgtgttttcatttctcttggctaaatacctagaagtaaattggctagatcacagggtaagtggatgtttaactttttaggaaactatcaaactgttttccaaactgattttaccattttatttccaccagcagcgatggagagttctggttgctttatattcttgccaacatttgatatgacctgtctctttaatttcagcctttctaatatgtgcatagtacttcattctggttttagattgcctttccctaataactaataataataagcatcttttcatgtatttactgaccatctgtatcttctttggtgacatgtcttatccaacattttaattactttgttttattatttatcgagttttaagagttatttatatgtgttctatgtatcttttagcagatatatgttttgtaaaatattttttatttcaatagctttcggggtacaagtggtttttggttatatgtattaattgtatattagttaattctgagattttattgcaaccatcacccaagtagtgcatgttgaacccaataggtagtatttatcccacaccccattcctaccctctcctttctgagtctctaaagcccattatattactttatatacctttccgtactcacagcttagctctcacttacaagcgagaacatacgttgtttggctttccattcctgagtgatttcacttggaataatggcctccagctccatttaagttgccgcaaaagacattattttgttccttctcatggctgagtagtatttaatgatttatatatacacctcattttatttatctactctttggtcagtgtagacttaggttagttccatatctttacaattgttaattggattgcaataaacatatgtgtgcatgttttttttttcttcatataatgactctttttttggtggggggatagatacacagtaatggcattgctgtattgaatggtagatctacttttcatttctttttttttgagatggagttttgttcttattgcccaggctgaggtgcagtggcgtgatctcggatcactgcaacctccgcctcccagattcaaaagattctcctgcctcagcctcccaagtagctgggattgtaggtgcccacctccatgctcagctaattttttgtactctttttagtagagatagagtttcactatgttaaccaggctggtctcaaacgcctgagctcgtgatccacttgcctcagcctcccaatgttctgggattacaggtgtgagccaccgtgcctggcctcaacagtgttttatagttctccttgtacggacattttatcttcctggttaagtatgttcttaggtattatatttttttgcagttaaaaaagtgatggaatttttaaatttgattctcagcttggatgttattgctgtataactgtgctactgatttgtgtatattgattttgtaacctgagatgtaactaaatttgtttatcaaatctaggagtcttttgaagaaatctttagagttttctaggtatacaatcatatcataagtgaacagtgatagtttgacttcatctttttcaacttggatgtctttcatttcttttttttcccctgattgctctgactaggacttccagttctatattgaatagaagtgataaaagtgggcatccttgtcttgttccagttctcagagggaatttcagcatttccccattgagtataatgttggctgtgagtttgtcctatatggcttttattactttgaggtaagtcccttctatgcctaatttgttgaaggtatttattataaagcattgctgcatattatcaaatactttttctgcatccattgagatgattatgtggcttttgtttttaaatctgtttatgtgatgtattccatttattgacttgcatatgttaaaacatccctgtatccctgggatgaaactcacttgaccaggatgtattatctttttgaggtgctattggagtcagttagctagtattttgttgagaatttttgcatctctgttcatcagggatattagtctgtagatttttttgttttttgttatgtcatttattagtctgtagttttgttgttgttgttatatcattttctagatactggcttcacagaatgatttaggaagaattccctctttctttatttttgggaatcatttcagtgggaataattgatactaattattctctgagtgtgtggtataattcagctctgaattcttctggacctgtatattttgttgttggtggtaatttctttaatttctaattcaatcccactgttactggtctgttcagggtttctacttcttcctgatttaatctagaagggttttatgcttccaggaatttatctatttcctctaaattttttagttgtgtgtgtaacagtgatcatagtagccttgaataattttttggatttctctggtattggttgtaatacctcctgcttcattcctaattaagcttgtttggatattctctcttattttcttggttaatctcactaatggtctattaattttgtttatcttttcaaaaaaccagctttttatttcatttcacttaccttttgtattttttgttgtaatttcatttagttctgctctgatccttcctatttctttctttctgatggctttgggtttagtttgttcttgtttctagtgtttcttgagttgtgacaatatagattgtcaatttgtgctctttcagcctttttgatgtaggcatttaatgctatgaaccttagtcttagcactacttttgctgtttcccagaaattttgatcactctgtcactattatcattcattttaaataatttattaatttccatcttgatttttacccaaaaatcattgaagagcaaattacttagttttcatgtatttatatagctttgagggttctttttggagttgatttccagttttacttcactatggtctaagaagatacttgatatgattttgattttcctgattttacagagaacaattttactgatttatttatcagatctaacaatttttaaatgaaatccttgggtttttctagatattatactatgtcaaatgcaatgaagaataacttgacttatttatttccaatttgaatgcactttattttattattattattttttgctcctaattgcactaacaacatcttctggtattatgttatataagaggactgacagtgggcatctttctcttgttccagtccctaggaaacattctttaatttttttcttgttcagtatgattttagtcatggatcatatatggcctttatcattttggagaatgtttcctctaaagtcattttgatggtttggtgatctaaaaccattataatttattatatagggatttggatttttatgggctttttttagcatgtactgaaataatcctataattcttggatctgttaatacggtgggtcatgtttactgatttgcatgtattgaaacatccttccctcctcccttgcacgaattctgtgttaccctagaaaattatcttcttaatgtattattagtttggtttgcttgtattttttgaggacttttgcatctacacttgtattagtccattttgacactgctaataaagacatacctgagactgggaagaaaaagcggtttaattggacttagagttccacatggctggggaggcctcagaatcataacggaaggtgaaaggcatttcttacatagtggcggcaagagaaaatgatgaagacgtacgagcggaaatctctgataaaatcatcagagctcatgagacttattcaataccacaggaatggtatgggtgaaactgccccgtgattcaaattaactctcaccacgtccctcccacaaaaatgtggaacttttgggagtacaattcaagacgagatttgggtggggacacagagccaaaccgtataattctacccctggcccctccaaatctcatgtcctcacatttcaaaacctatcatgccttccccaatattcctcaaagtcttaaatcatttcagcattaacccaaaagtccacagttcaaagtcttatctgaggcaagacaagtcccttccacatatgagcctgtaaaatcaaaagcaagctagttacttcctagatacaatggggttactgatattgggtaaatatagccattccaaatgggagaaattggccaaaataaaggggttacaggacccattcaagtccaaaatccaccagggcagtaaaaatttaaagttccaaaatgatatcctttgactccaggtctcatatccaggtcatgctgatgcaagaggaggattccaatggtcttgggcagttcagtccctgtggccttgcagggtacagcctccaccctggctgctttcatgggctggcaatgagtgtctatggcttttccagttgcatggtccaagatgtttgtgcatgtatcattctggggtctggaggatggtggccttcttcttgctgctccaataagcagtgccctggtggggactctctgtgggggctcacagcacacattttcctttcacactgccttagcagagtttttccatgatggtctcacccctgtagcaaacttctgcctggacattcaggagtttccgtacatcttctaaaatcaaggtggaggttcccaaaccccaatttttgacatccatgtactgcaggctccataccatgtggaagctgccaaggtttgaggcttccaccctctgaagccatggtctgagttctacattggcccatttcagccacggctggagtggctgagatgaaaggcaccaagtctctagactgcacacagcatgtggaccctgagccctgcctaggaaaccatttttttctcctagacctctgggtctgtgatgggagaggctgctgcaaaggtctctgacattcctggaagacattttccccattgtcttgaggattaacattcagcttttcattactaatgcaaatacatgcagccagtttgaatttctcctcagaaaataagattttcttttctattgcattattaggctgcaaattttccaaacttttatgctctgctttcctttcaaaaaggaatgcatttaacagcacccaagtcacctcttgaatgctttgctgcttagaaatttcttctgtcagataccctaaatcatctctctcaagttcaaagtttcacaaatctctagcccggggcaaaatgccacccgtctctttactaaaacataacaagaatcacctctgctctagttcctaacaagttcctcatctctatctaagacaacctgagcctggatttcattgtccataccatttccaatacttttgtcaaagtcattcaacaagtctctatgaaattccaaactttctctcatttttctgtcttcttctgagccctccaaactgttccaatctttgcctattacccagttccaaagtcgcttctacatttttgggtatcttttcagcaatgccccaccctactagtaccaatttactctatttttctgttttcacactgttgataaagacaaaccagatactgtgaagaaaaagaggcttggccaggcgtggtgactcacacctgtaatcccagcactttgggaggccaagacgtgcagatcatgaggtcaggagattgaaaccatcctggctaacacggtgaaaccccatctctactcaaaatacaaaaaattagccagacgccttggtgggcacctgtagtcccagctactcgggaggctgaggcaggagaatgccatgaacccggggggcagagtttgcagtgagccgtgatcgcgccactgcactccaacctgggggacagagcgagactctgtctcaaaaaaaaaaaaaaaagaaaagaaagaaaaggaggcttaattagacttaaagttcctcatggctggggaggcctcagaatcagagcaggaggtgaatggcacttcttacatggtagcagcaacagaaaatgtggaagatgcaaaagtggaaaccccagataaaaccatcagatctcatgagactcattcactataatgagaacagtatggaagaaacagtccccgtgattcaaattaactcccatagggtccctcacacaacacatggaaattatgggagtacaattcaagatgatatttgggtggggacacagagccaaaccatatcaatactcatcagtgatactggcttgtagttttattgttttgttatgcccatgctttgtttttgtgtaagagtaacattatcctcatagaatgagtttgaattattcccttttttttttatttctctttttcttttcttttttttttttgaaaaggttgagtcagattggtatcaagctgttacatgttgggtataattcaaaagtgggatcataagtttctgaacctttttattttgatgaaagacattttattacttcaataacagcttcaatcccttgcccattattatttgtttgatgttttcaaccgctttatagttcaatcttagtaagttttgagtccagaaattcatatatttcttctaggtttactattaatttatcataacaattctaatagttttgtattattttggtctcagtttttatgtctcttctttttccatttctgatggtttttatttgcatcttgtctatgtttttcttgcttaacttagctaaaggtttgttaacatcattgatctttgaaacaagtcagggtcactggtctggttgtctaaggtgttatcagagcttgtgatctcaggaccaaaaaaattaagaagcgtggttacaaagggtgaggttggagcaaaaatttaataacaaaaaaacaaagctctcggcagtggagagggttccctgatggttgctgtgttacggttgtattcaaaagctcttatgaggaactgctttcatctctgtaactgagtaacttttcttatctataaaactgcctgcatagtttcatctctgtaactgagtaacttttcttatctataaaaccgcctgcatatctcccagttattctctgtcattgtggatatgtctccaggaaagcacaaagtgctgtttcttgcgtttgtataatgatgggtttgttttaggtacacccccctcctctctttgcaaattcccatggagcccactgtgtacatgtctgaaaaggggaggacactttttcctgggagcttactaatcatacaaagagcaaagggtttctatgctggacattgcatgccttgcctgcttatctgtggcttatctgtgcaggtgcactgtagctgtgattttttttttaggcaggcagcttctgcagtctgagtttttccccaagctgctctatttttcctgtagttgtgagttttcaggaaggcagcatttttgaggaccagccttaattgtttacttaactgattttctcttttcttctccatcatcttcacaaaaaaacaactttttgtttcatagatcttttgtattgtgtttattttagcctcaaatttatttaactgtgttctggtctttataatttctttctttctattagctttgggtttggtttgttcctgcttttttagttctttgatgtataggattaggttatttgaagtctttcaacttttttgatacagatgtttgttacaagaaactttcttcttacagtttttttggccatcttccatagatgttggtatgctgtacttccattttcatttgtctcacaaaatttttaaattttcttcttaataacttcattgacatgtttgtcatttagcagtatgtttaatttccatgtgttcatgtctgttttccagattcttcttttaatttattttttgttttatttcattgtggtcagaaaatatacttcatatgatacttgtgtttttgaatttgtacaggcttgtttggtagcctatcatagaattaagggagacattttttgtgctaataaaaagaatgtctattctacagcaattatgtgaaactttctgtatatgtcagttaggcccttcatatctagtgtgtactttaactctgatgtttctgtgttgattttcttcctggataatctttccattacagagaatggggtgttaaagtctcctactattgctgtgttgcatgctagttttgcctttaggtctgttaatgtttgctttacatgcttgagagctcaggttttggtaagtataatgactaaatcttgctaaactgaccccttcattatcatgtagttactgtctttgttttttgttttttttttcccgtctgatttgtaatctgtttataactacacctgtacttttctggtttctagttgcatggaatatattttgccatcccttcactttcagtctatgtatggctttataagtgaagtgggtttctttaaggcagcatgattctttattcagccattctatgtcttttaactgagaactgagacaatttacatccatttttattattgacaagtaaggcttactagagccattttgttgattgtttactgtttgtttttagactcctctcttccttccttcctgtctttcttcataattaggtgattgtctctggtagtatatttcaagttgctgctttttaagtacatcaatgatagatttcttaactgtggttaccagtagacttacagaaaaccattttagagatatggcatgttattttaaagagatcacaacttagattgcaaataaaattataaaataaataagggcaaaagtcacagaaaatgtatatactttaactcaatcacctacccattttgactcatagttatcttgatttacatatttgtatatcatctgtttcttaaccggttgctatagttgttatgttttctgggataggtgaaatgcagaacacaaattcagtactagcttattctgggtttttgcatgtactcaattttaccacttgtttttataccttgaaaagttactttttgcatgatagtgttttactctttctgactgaagagctcccattagcattttttgcaagatgggtctggtggtggagtctcaggacttttccttagttcagctaaagatgggatccttgtctgtcccatggccacaaaaatttaggctcacagatggtttgaatgtcgaggactctgaaaggccagagtccccctgctagagtgcttcctgctcaaagcttgaatcccagcttccacacagaaagaggaggggcctggctcttccccactgcaaatggcacaaacttgctgaggttccaccccagtgaacatttttctcagtgttcaagctctttggagattctctggggaccacctcctacctggctgtctctttcccccttgtaaagaagtacatctgaatgctatttgaaagagcataaggaagatcaatctttactgcttcctgctgacaaggggtgctgtttttgggaaatggtggtcagagctcactcacaggcctatctaagagttcccccagcagaaagggccattgtcagagactctgcttgcattattgtttggagtttgatgccctgaaggcaagaacagacaaactaggttattagaaaacatgtatcaaaatgaaacaaggggaggagtaaggatagctcaaaaattctgaggccttttatcactttgcacagggagagaaaggccaaaagccagactggtaaaatacccttttgctggcatgttggtcttctgggttcccttcttctgggcccaatctttagccaaccagcttaaggtttggaaagttaactctttccagtttggaagatgcatctgaggggaatgtcccagaatacggagacataattacctatccgtgaagagagaacagaggagaagaaaggaaaaagaaggcaccttttaaagaagtcccagggggtcatgatgcattcaaaatgggtacagactgaaggtgaatggctactcacctaggaagagggtggcaggtgtccctagttctcttctctttctagcagatacctggggtacatgagggagaaagagcatcctcttttcttcttccgtccttgcttccccgagtgctggtaaccttggtatgtgctgaaacaggtgtcaaagcaacatgcacccatgaaccagtggggcctagggggtgagaacattcactcttacccacttacccacatacaccctatctcccctgctttcagtagtctgggagtccctagacctcatctatgccatggatactaacaaggcttttatccatgaaccagggagcttgggcttcacttaattggcaggaaacagccacactcacctgcactgtgcattttgttgcacaaagtaggggcttatcctgccttagggactgactctttttcaggtttgatatctgcatgttttccttggcctggctcttataaaaccccacccaggaactgggttttctcctgcctgtctgcgtgtgtgttatgtgtaatgtctgcagaaagagctctaaatgattttggcctgaaaaagacaaacacttgcatctaatattttttaaagagaagttaaaaactgtggtaccgttcagttcacgtgactttaatctttgagaaataggaagaggcttaaagattaatggtaaaaagcagatgtcattacagtgtaaataggtggactaaataacgcaatggtgtctttgtccatctcagggccatgaaaatttaggctggcagatggttcaacaggtgagtaaagcagggttttattgggtgaaaaggaaaaaaaaaggggaaacagggatcttccacaaggctggagacccctgccagagtgcttcccactagcagcttgaatcccaggttccacatgggatatttgccgggctcctccctgttgcaaacagtgcaaaattcctgaggttccaccccagtgcacattcctcccagtgcacaggcttgttggagattctctggggacctccttctcctctgactagctcagtggtcaattctatgttttgtttgcctggtaaatacttcatctctcatttatatttgattgataattatttttgtttcaatattttttggtggcatccttttgtgttgagcactttgaaaacatcattccagtccttcctggtctgtatagtttcttttgggaagtctatctccataaatattggcgctgttttatatgttatttgctttcacttgctgatttcaatcttttttctttaatgtatttttttttgtcctttgtgactttgattattttgttaattggggtagtcttatttgggtttgcattgtgttctaagacctttctgtacctggacattttatgtttctcaagttttgaaaagttttttgttactatttttttgaatgagcgttctacccttgctcttactcacatctctcttgaacaccaataattcttagactgggtcttttgaagtaattttctatattttgtaggtggcacttgcttttttattctctcttgactttttaaaaataaaataacgagtcttagagctcacagattcttttctgggcttggatcattctgtggtttaagacctctaatggattttgaattcagcaaatgcatttcttagttccaagatttctgattgatttctttgtattattttaacctttttgttaaatttctcggataaatttctgaaataacttcctgtgttaacttagacattactaagttttcttaaaactgctattttgtattctgggtcagagagctcagaaattgggttatcttattagtgtcaatcactagatttttgcattgtccttttggagaggtcctggttccctgttctctgttgtttcttgtgaatatatgcatgcctttgcattgaaggattatttgttccattttttttctgtctttttttaatggaatatatttgcttagaaaatctttaccgaaaagtcactgcattcactttagttctaggtgacatgttaagcccaggtttacctcagctcatgtgaatgattagagctctgcctgtcccaagtgatgggggttccaaatggattatcctggaagtgtgagaacactgcctaagggcttgttcccagtatacctaaagaacttacatcctacagcatgctgttgctaagcaactactctgatttgaggtcaatttttggctgagttacggagaagagtttccatgtctaagaggttggtagtcctgcctctcttttttgtctctgcctgtcctcaggaatgtttctcccttcatgcactcataacatttccactgggttaaggaaagacaggtctaccagggaacttgataagatggggaagcttagtgaccatatcagtttgtctttctctcatttatataaaaattacttgacattgagtaatttataaagtaaagaggcttaattgcctcacattctgtatgctatacaggaagcatagtggcttctacctctcaggaggcctcaggaagcttgcaatcatagtggaaggcaaaagggcagtcaacacctcatatggccagagcaagaggaagggagttgtaggaggtgctacacacttttaaacaaacagatctcttgagaatgctgttacaagaacagcaccaaagggatagtgctgaatcattcatgaaagatccacctgatgatccaatcacctcccagaaaacccatctccaacactggtgattacaactgaaaatgagatttgggtggggacacagatccaaatcatattgtaaatcatgaattggagatagatattctgcgtttttggtgcagagcagagttgcaagttaggggcattattaatgtagacatagacatataattcccctacgtagtgtctactcagactttttctacttttatgacactgggaaatgtgttatcctcttaattaagcttttggttgttgtggtgtagatctcagtgccatatgtttgttttgttttgttttgcatgaagaaaaaaaggctgcttgtctctactctgccattttggaaccagaagtctcttgctccgtatattcttaataaacgtttcttatcagatatatgaattagaactttttaaattctacttatcatcagtacacttttttgatggtgtcctttcaagaacaaacatattcatttataagaatatcagtttatccattttaacttagttttttgtgactttgttgccttgtcctagaaaccattgccaaattgaagatagaaaagatttactttttctattctgggttttgtacttctgtttgttaactttgggttgttgatgtattttaaattagttctttatgtgttgtcagagaaagtgtatcttgtttttttggcctttggataatcagtctcccagaagtatttgtggaaaatattgttgttttcctattcaatagtttgacgtctttctcaaaaattaagtcaccactgtgtaaaaggatttctggattctaaaatctgttccatttatttatatggtgatctgtgttcctgtgtcacactcttataactattgatgatatgttgttggttgaaaatcggaaatgcaaggactaaattatttttcaaaatattactggttattgagattgtgccactgcactccagcctggccacagagcaagactctgtctcaaaaaaattatacatatatatatatatatatatatatatatatatatattgtgtgtgtgtatatatatatagtgtgtatatatatagtgtgtatatatatagtatatatacacacacacacgtatgtgtatgtgtgtatatatatatatatatctcgctattttttggtctcctgtatatctatattaatttagaatgagcatgtttatttctgtaaagaacccagctgggaatttaatatggattttggttaatttgtttattaattaagattttcaattgaggaatatgagattttatttattcattaagaattttattcctcaatatttagtaacttttacaatttaagttttaagtttcgcaatttattttatttttttgagatggagtctcattctgtcacccaggttggagtataatggtgccatctcagctcactacaacctccacctcccaggttcaagtgattctcctgcttcagcctcccaagtagctgggattacaggctcacgccaccacgcctggctaattttttatatctttagtagagctggggcttcaccatgttggccaggctggtctcgaacttctgacctcatggtctgcccgcctcggcctcccaaagtgctgggactacaggcatgagccactgcacctggcctaagttttgcaattcttttaatgtttttcctgtttttttaaaataatttttgattatattttatgtaggatttttgaacatgttattttcttctgtattgttcaattatgtaacaatacaattaatatttgaaggttgaccgttagtcctaaaaatgtgcttattttgttgttgatctaatattttctaggaaagtctaagatattctttacataaggtcatgccttttgtcaacaaagagagtgtacttatttcttaccttctaataaggattatttttgttttgtgttacttcctatttgctttggctggaatctccaatataatgttgaatagaagtaataagaatgaatgtctagtcttttccttattttagaaaaaaatgagttaatcttcataataggtgtctccagacaaaaagagccatgtatgaatacacacacattagtacacacctatgagggaggattttattgtaggaatttgcttaggctgagaaatattatgatatacacttacacactttatatttaggaaagctgatgctgtaattcaatctgagactgaaggccttagaactaggagaaatagttgtgtaattatttgtctgaggatgatggccttagaacttaaggagctacaagtggggtttactagtgcaaaccctagtgtccaatggcccaatatccagaagcctcaaataaagaaggcagaataatattaatgtcccagccaaagaaaagagaaatatttgtcttcttctgccttttgctctatttgggttcttaacggattggatgatacctgcccacaatcatgagagatatctttagtcagtctactgatttaaatactaatctctttttaaagtattgtaacgtttgtcacagaatcataaaaatatctatcctaaaattcatacaaaccccaaaatagccaaataaatcataaactaaaagaagaaagccagaggcatcaaattacctaatttcaaaggatattaaaagcctgtagtaactaaaacagcatggtagtagtacaaaaacagagacatagagcaatggaacagaatagagaaccaaataataaagccacacacctactgccacctgatttttaatgaagtcaggaataacaagcaatgaagaaagaaccctctattcaataaatgatgctgtgataattgtatagtcatatgcagaagactgaaatttgacctcttcctttcaccacatacagatatcaactcaaggtgtattaaatacttaaatgtaaaatctaagactatataaatatgagaagaaaacctcagaaataccatcctggatacaagccctggccaaagttttatgacaattaccccaaaaggaaattgtaacaaaaaaaaaattgacaagtgagacctaattaaactaaagaacttgtgcacagaaaaacattcaataacataaacagataacctacagaataggagaaaacatttcaatactatgcatccaacaaaggactaatgtttagaatctagaaggaacttaaacaaattaacaagcaaaaaagaaaaatcccactaaagagtggccaaaagagaacagacacttctcaagaataagtacacatggccaacaagcatatgaaaaaatactcaacattactaatcatcagagaaaagaaaatcataaaaaccactataagataccatcccccctagtcagaatgaatatcattaaaaagcacaaaatgacaggtgttggcaagattagggagaaaagaggatgctcatacactgttcgtgggaatgtaaattagttcagccactgtagaaagcagtttgaagatttttcaaataacctaaaatagaattaccattttacccatcaatcgcattactgggtatatacccaaaggactgtaagttgttctaccagaaagacacatgcacacctacgtttatcaacagcatcacagtactattcataatagcaaaaacatggaatcaatctatatgcccaacaatggtggcctggataaagaaaatatggtacacatataaatgatggaatactatgcagcaatgaaaaaaaaacaaaatcatgtctcttgagcaacacagatgcagctggaattcattaccctaggcaaattaccaccagaaaggaaaaccaaataccacatattctcagttgtaagtgggaactaaacattgagtacctatggacaaagagaaaggaataataggcaatgggaaatatgtgaaagtgtagaatgagagatctatgagaatcaaaaaactacctaccaggtactgtattaactatcttggtgatgaaataatttttacacaaaaaccctgtgacatgaaatttactcatgaagaagttgacactttaaccttctgaacctaaagtaaaatttagaggaggaaaaatgaaatgctctcacagataaatccagaaataattttttttttttttagctatttggtaatctcttaaaccagtcaagttgacacataaaattaaccatcatagttg

SEQ ID NO: 96 - DNA, 566770 bp, Homo sapiens
  misc_feature (154667)..(254666): n is a, c, g, or t
tgctatttaatttttttagagtcctcgggcgtccgtgatattagtgttagtcagttttgttgtgagtgttagaaagagggcatatagaaccaggaagctgataagaaagacgattatgagggcgtgatcatggaaggcaattagctcttttataataaccataaagtaattagctcttttataataactataaagtaataggactgtagcaatcttttgttccacctcagtgacttgatgtatatactggaaacagttcttagtctgaggaaggtcagttgaagtccttcctgtacaagtccaaattctgaggaaaatgagtcctgcgatgagtctcctcatgcttcagccatgcgtggaccagtcagcttctgggtgtgactggagcagtgtttgttgtcttcttcagagtcattttgcagggattggtgaagctgctcccatccacgtacagctcccagtctactgatgtacagttatgtttaactgggctctctgataataggagtaagatagtgagcttagggtgttgcaaacttcaatggttatgtggggattttcacaatgcaagctttggtatctagttagtctatcatttattagctaatgatgtcctttggtatttattaaaattaccacagcatggggagactttatgtttaggtttttcctaagagttagcttatttgcttcttgtgttaacagggctgttgctgccagggcccttggacatgggggccagcctttggaaaccccgtctagttgttttgagagacaggccattggccttggccaggaacctccagtctgggttaaaactccaactgccatttttttctctttctgacacatagagtgtgaagagttttgtcaggtcaggtagcctcagggctggggccgacatgagttttttttttttttttaactcatgaaaagctctttgctgttggttgtaatagatgtagtttatctaatctacatttttattgactgttatctactaaaatattgacttaaatcttgtaactatttgatttcaagctttaaattgatctggtattccttgcagggcttcgattgcatctaaatagatgtgagagttgaaagacttataaggggctcctctcactttacgatgtgttattattattttttccttcctctggttgatgaaatgccagggtgaaagggatagcccaatggactaaggcacaaatgccactctagttatttggcagagtgcctagtaaaggtccaccacaatactaccacacatctgctcagggatgaacaagggctgattgattgataagctcttgaaaattcttaagctcactgcatccttttaggtctccaaggaatgctaagtttcctccctgccgtgagagacaggaagtgaacttagtgttgagagacagaagctggatggcccttgggggctgactggcagggacttcaggatatagcagagagagcttggcatgacttattactccaggctgtagaatcctggaaaagagctaccatcaggcccacacctggtgaactggaggaccaccgtagtgggaaggggacaattagggcctctggcctgccatgtgcacaagcataacaattgcttttgtttattgtgtagttggaatatttgatccatttcaaccaggcatttgtagcttgatatactgtcttaattgctaaagtttgttttaagtctttaacttttatgatcctctagtaaaatgaatatttccattagcactaatttttattagtttttagaccaaagaaagctaaacatcattttatatttaatgtttcttgtatgatttttataccagataagctaaattttacttttatattagtgtgttattaatattaaacttaattttaataaaaccttgtagacatatttatccaatttttcatagttgaccataaggtaagattttatagactctgtttaaccttttacaatttttgttaaagagcaggttgatgctttaaggaaaaaacctgttgcatttttactttcatgtctagttcacagaaaaactggataatacttttttaactttagctaataagtttacacacagaattttctttaaattaacattttaaaacttgcttgaacttttcaaacaataattcttttttgactttttaatgtaggtaaaaatccacattcttatgcctccttataatcttctcattaaagttatattttacttttttatacacctgcacataaactgtttcttcaatagcactcaggaggccttattacttttaaattatgcaacattttttgcataaaattttttataactttttttcacgactttcgccaacaatttttcaacatgtctcaactttctgacttattacaaacatttttttcttctctttaaacaacaagttaatttatttcaggacaagaatttaccatataacactctttttacataaattttacctcctccccccccttttttttttgaagataaccattccttttttttaaaaagtgaactttctttatgtctttggactagactgtctaaggccacaagattagaagttaccataatatgtgttacactgtcaacttttagcaaacttcgcttttgttgaaaaccttgtaagtttgaaatttcaattatcctttgctattaataagaccttgtttagtctaaatttacttagaattggtatagatggccttttttttttttttctctgctggtctttccttgcctctgccagctgcttatgctgctgttctcttaactattgtgagggggggtggggggaaggggtctaaaaccagctgtaactgtctatgtacagaacctggtctgggtgccttggcttacaggttaccttgtgccataccttagaaactaaaaagacctatctaggcttccttctgatggctaacctacctctaatgctggccaatctatttcacacaaagttctaagttttcctggagtcatagtgactccatagtctctattaaatcctttcttgaaattcattatcatagttcccagtgcagtgggcttactttgtgcctgatctatgtttttttgagacaaaacaccatgctcacagcacacacacaccacaaaacaaagaacgggtaaaagggcacacacaaacatttcagtttacaccaaaccaaaatcaaaaccaaaatcagagtatccagaaatccaagccaggtcaaaaaccaaaaccaaagtatccagcaattcaagtcaagtcaaaaccagatcaaaagtgccaatacaggcacaccgtgggtgatcaggctatgctacacttccattcaggtggagtggggcaagttcaaaagactagtcctaccaagtctagccaagtcaaaaccagaacaaaggtgccaacacaggcacaccgtgggtgaccaggccatgcttctactcaggtggagtgggacaagttcaaaagactagtcttaccaagttccagatgtccagactccaagtgccagttccttcccggtgttcagccactgtgttaatcctccacgggggcctgctacgtgttgatctggtgaggtgttccactggggcaatttcctacccaggagcgctctttggatctcatcactcaggctgcccggagtaccccacagggatgctccacagggcaggcttaagccacctaaggggctgcctcagccttccgtcagtcaccttgcttctgggtcagggagccaagaaatgtagcaggacgagccacagacaaaacctctcagacatcgagttgtagaaggaagggctttattcagctgggaacattggcaagatactgccttaaaatctgagctccccgagtgcacaatttctgtcctttttaagggctcactacactaaagatttcacatgaaagggtcgtgattgatttgagcaagcagtgggtatgtgacaggggctgcatgcactggtggtcagagagaaacagaacagggcagggagtttcacaatgttcttctatacatgtctggaatctatgaataacattggtttctaagttatgagttgagttttaactactaagtttaggccaggcaggcccaggcatagtttcagtcctggcgtttgggctgcctgtctttggttttacttccttgttgttttttcttaaacatgtactgagtgaaaaacaatataaaataatatgagaaggtctttctcttccttcacatgcacattggtcactgatctcgcctactgttaggcttccctgggagcccagttaacaggggaaaatctgcatgacctctcttggtttctcctgtcccaaaatccaacactgatccaagaaggctccagtatgtgccaggcactccctgatcatctggtcttagggggacgcctctaagccatttgattccgttccaggaaccaaaaaggcagaggtgataatagctccttttattgtcttcctccagctgtccaggacagtcttctttttccctgttctccagagcctaccctttgatatggaaaactccccatcctccattccaaaaaacagccctccagactgcctcataaaaaatctgcaaaccttaggcctcaggcaagatacccaccctaagcgccttgtcttttttatacaataaaacctggccgcagtatgaattagataacgggtccaaatggccagcaaatgaaacacttgactttacaattttaactggttaaagcaattattgccgatgactggaaaaatggggagaaattccttgttccaggcctttttgcactcagatcacaacctgacttctgcaattcttgcttacctgttcaaatccttcattctcaccgccctcataacctttctcctcctgaccctacctctttttccttgttggatccagcagactgctgtccacccctcccagcccctacccccacgtctcaaccatcttctataactccccaagctttctcattgtcttcgcagtcaccatcttcccagccaccatcttcccagccggcatcacctccaaaagtacccacttctttttctacaccgtcctctcctcaggaaaactctagcattgcctgtactcagtctccttcctcactgccctctcctgaagcctgtaaacccatcaagccaccttacacccctatgtatcctccactgcctgtcaactcaacccgccttcccccttcaaaccctcagcaggaaccccttctggcttctttcttctctcctgtccataccagcttgggcaccatctttggcccacgctgcacccatacttcagtgcgggtgctagaatgcccccttcaggaagtagcaggaactgaaggtattgttagagttcatgttcccttctccttcactgatctctcaaactaacaagactcagttcatttccagaagaccctacctcttatattagggagtttcagtaccttacccagtcttatgcactaacctggtatgacctctacttatcctgtcttccaccctcaccttctacttatcctctcttccaccctcaccccagaagacagggaccatatttggaccctggttcaggagcatgctaatacaattcatcatcaagctcctgcccagcctactggcacggaggcagtccccaaccaggagccccaccaggattatcaagacagggcctctggacactgccatcaagaccacatgattgtgtatctccttgcaggactcaaaaagggtgcccataaagtggtaaactataaaaacctttcagaaatcacccaaggtcctgacagaaacccagccttttttctctcttgtttaactgaagccatgagaaaatataccaacctagacccagccaacccagaaggaatcactattttaaacctttggttcctcatccaatctacccctgatatttggtgcaagattcagaagcttgacaatggccctgaaaccccacaatgacaccttcttaatttagtcttcaaagtctttaacagttataacgaggaaagtaaaagaaaaaaaaaaaagacagagtttcaaatgcttgcctccaccatcacgggccctgcaggcccacaggctgcagctccacacagatgcctcctagcaatccacctccccctggcacctgtttcaagtgtggcaatgaaggccactggtccaggcaatgcccaaacccaggtaagcccaccaggctgtgccctctctgcggaggaccccactggaagtcagactgtgaggtgccccagcaaggaccgcccccatccctgccccagccggccaaaacctcctactaggatctcatcagccttgccgctgaagactgacagtgccctggaacagatgccccagcaactaccattgcttcatctgagccaaggataaccttgatgttggcagataggccagtattttttttttaattaatattggggcaacctactctgctttacctaaattttcaggacccacccagtcctcccaagtctctgttgtgggaatcaatggacaagtctccaaaccccaagacccccctccacttttctgctccctgcacaccttttccttcagtcactctttcttagtcctgccttcatgcccagctctgctcctaggcagagatattctttcaaaactccacactactctccacttccacattccccatagtacccaacacatcaacccagacccctccaaggcttctaacaggcttctaactttcttctactcctccgacctcccaccctgaagcatgcaacttttccttatcccgcacctgtagttaaccccactgtttgggatacttccacaccctcggtcacagagcaccacacccccatccacatcacccttaaagagcccaccccgttcctatcacagaagcagtatctcatcccccaagcagctctcataggcctaaagcctatcatttctctcctcctcaccagtcacctactctgcccaacaaactctccttttaacacatcagttctacctgttaaaaagccagatggaacttatcacttagtccaggacctcaggctcattaaccaagctgtactcccagtgtgtccagtagtttctaacccatatactttactttcctcacttccctcgaataccacccatttttctgttctaaacctaaatgatgctttttcacaattcctttacaccctgattcccaaaatctctttgcctttacctgggagaaccccgacacccacctttcaggtcagctcacctcgtgtgtactacctcaaggttttagagacagcccccacctttttggacaggcccttgctagtaacttctgtactttatccctaaaatcatcctctcttctttaatatgttaataatctgctcctgtgtagcccctctcaaagagactgcaacacccatacatactatctctcttttaaacctcttggcagaacaggggtatcaggtctcccctaagaaagcccaaatatgcaccccccagtcacctatctaggcctagctctcactcctgaacgcaagggctcacaacagaccacatattccctccttcagtccctcccgcctccacaaactaagcaagaaattctctcttttccaggattagcgggatattttaggctctgggtttcctccttcgctttacttgccaaaaaattatacgaagctgttaaagtccctctctatgagcctttaaaacctgcacagcctattacccaacctttccatctactccaaaagtctctcatctcagcccccatcctcactctcccagacttcaccaaacctttctccctttatactgatgaatggcgtggagttgcactaggtgttctaacccagtctaaggggcccacccggccaggttgttgcctacctccctaaagagcttgagaccacagttcttggatggcctgcctgcccctgagcattggtggcagctgctctcctcactcttaaaagcctaatactatctcttcatgccaacctaacagtttattcaacccataacatcaaagacatgttagctcaccgcagtgtactaagtcttttctctgccccacggctcctccagctgtatgctctattcatagaaactccccacatcaccatgctaaccacctcccatctaaacctgtccatgctcttacctgaagctacaactgcccaagactctacactcttctgtgtgaatactgttcaaacctttcttataccttttccatacctaacagaccaatcccttccagatgcctcctttatttggtttgtacatggcagctccttcctacatcaaggacactgacatgggggctatgctatagtgtcaccccccaacactattgaagccaatccgctcctcttaggcaccacctcccaaaaagctgaattcaatgccctcactccagctctcactctagcatccggaaaacagatcaatttattcaaattctcattatgcgctccacgtagtgcactcacactcatccatctggaaagaacggggtttcctaactgcaaacaatactcctgtcataagacaagtcttctagtccttgtctgtactttctctgggtaggtagaagaattcccaacaacttcagaaggtgcaactgtcatcgcacaaactcatcatgcatacctgcaattccccgttttggactcccaacatccatccagtctgataacagtcctgccttcatcagccaaattacccgaggcatctctacatccttaagaataaagtaagctctccacacaccctacaggcctcaatcttcaggcgaagttagaaaaattaactctgtctttaaagcccaactcaccaagctggctgtagaaacccaacagtcgtggacaaaaaaaatctccctttcgccctcataagactttgcacaacaccaaaagcacactctttttatagtccctttgaaatcatgtatgaccaaaattttgtcttggggcctccacccttaccagactctgagccactcagaaattaccacccctccttaatccagacatggtctttcatttgtgaagcagcaaatgagccatgcctctccctgtcgacacctcctggtcctctcaacataactgacttgcaggcacagacatgtttccagacaatacagatggtgctcctgctacagcgacatggtggataccaacctgtctctcaagaataccccaaaaattaagttttttttttccaaggtgcccactccaatccctgtgtcatgcctgaagtagttactgagaaagtcaccccttttccctttattctataaccaaataaacaggaagattctccctggggcctgaaagcttgaagggatgagtaactcctcctctcaggcccagttccaagatgcaaagccatttgtgtcaacagcttgcatcagaaagatagcagaagcaggaagagagccaactggaagacacctaccctggctggaagacacatacccctgaagatcaagaaagagaccgtctgggtactacatagcagtcacatcagactgggacacttactgtttacagaggactacaaaacccctgtcccatcctcacttggggctgacgcccctttaggccctagcccacctgcacccaggtgctcattaaaacagcatgttgctccacaccacctcgtggtttctgttggcatgctctcagggtttgaaccgatacaagaacattacaggggtaaaactccacagtaagagggacttctctagctgaactttgtaacaatttgaacaggcaagaagcctcatggccagaaattgggggagggcatgaatctagcttgcagacttcacaggcaggggaagaactaaagcccttttctttgcagctgggaggtggaaaatctcaggcaaatattcaagtccaactctccctcctccttgaaaaagactcgggactattgcaggggccacggtggaagtgggagtggcccttcagtgtgcatgggaggtgggttagaactgagactgctggctttcccacacttccctgacgacctcatgactcagcagaggcagccaaaatccacctaggtacacaactccagtgacctgagaatctcacctccatccccagcagtagccaaagcaaggccctcccaaggaaggtctgagctcaaacacgcctggacctggcccacctggtggtccttccctacccccctggtagcagaagacagaggacctacaatcttgggagttgtagggccgtgaccaccaccagtccctctccacaatactacagctgatgctttctggaaagtaccacctcctggcagaaggccaatcagcagaaaatagagcattaagccaccaaagctaaggacccccacagagtcctttgcaccctccacctgaacaggcactggtatccacagctgagagatccatagatatttcatatcacaggactctgcagacaacccccagtaccagcctggagctggatagacttgctgggtggctagacccagaagagagacaacaatcactgtaatttggctcacaggaagccacatccacaaaaaaaggggagagtaccacaacaagggaacaccccataggacaaaaaaatctgaacaacagtcttcagccctagaccttccctctgacagagcctacacaaatgagaaggaaccagaaaaccaacctgggaatatgataaaacaaagctcgttaataccccccccaaaaatcacactagttcaccagtaacagacctaaaccaagaagtccctgatttacctgaaaaagaattcaggaggttagttatgaagctaatcagggagggaacagagaaaggcaaagcccaatgcaaggaaatccaaaacataatacaagaagtgaggagagaaatattcaatgaaatagatagctgaaagacaaaacaataaaaaattcaggaaactttggacacacttttagaaatgcaaaatgctcaggaaagtctcagcaatataatagaacagatagatgaaagaaattcagagttcaaagacaaggtcttcaattaacttgttccaataaagaaaaagaaaaaagaaaaagaaaatatgaacaaagtctccaagaagtctaagattacgttaaataaccaaatctaacagtaatcggtattcctgaggaagaagacaattcgaaaagtttggaaacatatttgggagaataattgaggaaaacttccccagtcttgctagagacctatacaagaagcacaaagaacacctgggaaattcatcacaaaaagatcttcacctaggcacattttcatcaggttattcaaagttaagatgaaggaaagaagctgggcatattggctcacgcctgtaatcccagacctgatcaggtggtcggaggtgggtggacaacctgaagtcaggagttcgagaccagcctgaccaacatggagaaaccctgtctctactaaaaatacaaaactttgctgggtgcggtggcacatgcctctaatcccagctactcgggaggctgaggcaggagaatcacttgaacccaagaggtagaggttgtggtgagatcatgccattgcactctaacctgggcaacaagagtgaaactccatctcaaaataaaaaaaaaaaaaagatgaaggaaagaatcttaagagttgtgagagagaagcaccaggtaacctacaaaggacaacctatttgattaacagcagatttctcagcagaaaccctataagctagaaaggattagggccctatcttcagcctcttcaaacaaacaattatcagccaagaattttgtatccagtgaaactaagcatcatatatgaagggaagatagccgttttcagacaaacaaatgctgacagaattcgccattaccaagctaccactacaagaactgttaaaggaactctaaatcttgaaacaaattctggaaacacatcaaaacagaatatctttaaaacataaatcacacaggacccaaaagatcattcaaggctgctatgaacacctttatgcacataaactagaaacttagaagagatggataaatttctggaaaaatacaagcctcctaacttgaatcaggaagaattaaatacactgaacataccaataagaagcagcaaggttgaaatggtaatttaaaaattaccaacaacaaaaagtccaggaccagacagattcacagcagaattctaccagacattcaaagaagaattggcaccaatccttttgacattattccacaagacagagaaaagaggaaccctccctaattcattctatgaagccagcatctccctaaaaccaaaaccaaaaaaggacacaaccaaaaaaggaaactacagacctatatccttaatgaacatagatgctaaaatccttaacatgatactagctaaccgaatccaacaacatatcaaaaagataatccaccgtgataacgtgagttttacaccagggatgcagggatggtttaacatacacaagtcaatatatgtgatacatcacataaacagaattaaaaacaaacatcacatgatcatctcaatagatgcagaaaaagtgtttgacaaaatccagcatcattttatgattaaaactctcagcaaaactgacatacaggggaataccttaatataataaaagccatctatgacaaacccacagccaacgtaatactgaatgggaaaaagttgaaagcgttccctctgagaaagggaagaagacaaggatgcccactctcaccactcctcttcaacatagtactagaaatcctagccagagcaatcagaaaagagaaagaaataaaggacatccaaatcagtaaagaagaagtcaaactgtccctgtttgctaacaatatcattgtttaccttgaaaatcctaaggactcctccagaaagcacctagaactggtaaaggaattccacaaagtgtccagatgcaagattaatgtacacaaatgagtagatcttctatacaccaaaggcaaccaagcagagaatcaaatcaagaactcaaccccttttacaatagctgcaaaaaagtaaagtagagtaaaatacttaggaatatacctaacaaaggagtcaaaagacctgtctacaaggaaaactacaaatcactgctgaaagaaatcatagatgacacaaacagatggaaaaacatcccatgctcatggatgggtagaatcaatattgtgaaaatgatcatactgccaaaagcaatctacaaattcaatgcaatctccatcaaaataccacgatcattcttcacagagttagaataaacaattctaaaattcatatggaaccaaaaaagggcccacacagccaaagcaagactaagcaaaaagaacaaatctggagccatcacactacttgatttcaaactgtactctagggccatagtcaccaaaacagagtggtactggtataaaaacaggcacatagatgaatggaacagaatagagaaccccaaaacaacacaaatacttacagccaactgatctttgatgaagtaaacggaaacataaagtggggaaaggacacccttttcaacaaatggtactgggataattggctagccacatgtaggagaatgaaactggatccttatctctcaccttatacaacaatcacctcaaaatggattaaagacttaaacctaagacctgaaactgtaactctagaaggtaacattgggaaaacccttctagacgttggcttaggcaaggatttcatgaccaaaaacccaaaagaaaagcagtaaaaccaaagctaaatagctgggatctaattaaactaacttttgcacagcaaaaggagcaggcagcagagtaaacagacaacccacagagtgggagaaaatcttctcaatctatacatctgacaaagtactaatatccaggatctacaacgaattcaaacaaatcagtaagaaaaaaaaaaccccaataaaaagtgggctaaggacatgaatagacaattctcaaaataagtatacaaatgaccaagaaacatatgaaaaaagtgctcgacatcgctaatgatcaggcacatgcaaatcaaaaccacaatgcaatactaccttactccttcaagaatggccatagtaaaaaaatcaaaatacagtagatgttggcatggatgcagtgatcagggaacacttctacactgctggtgagagtgtaaactagtacagccactatggaaaacagtgtgacgattccttaaagaactaaaagaactaccatttgatctggcaatcccacttctgggtatttacccagaggaaaagaagtcattattcaaaaaagatacttgcacatgcatgtttatagtagcacaattcacaactacaaaattatggaaccaacccaaatgtccatcagtcaatgagtggataaagaaactggtatatccatatgatggaatattactcagccataaaaattaatgaattagtagcatttgcaatgatctgaatgagattggagattattattttaagtgaagtaactcaggagtggaaaaccaaacatcatctgttctcaatgataatgtgggagctaagctatgaggacacaaaggcataagaatgttacaatggattttagggacttgagcagaagagtgtgaggaagcaagggataaacgacaacatatgtggtacagtatgtactgcttgggtgatgggtgcaccaggatttcacaaatcaccactaaagaacttatgtaaccaaataccgcctgcacgccaaaaacctatggaaaaataaaaaaaatttaaaaaatgaaatcatacaatgtatggtctttagtgagtggcttcttgtgcttagcataatgtattaaaggttcacccatggaagagtgtatataaggacttcatttctttctattgtcaaatagtactccaaagtgcatatatactcattttatttgttcatttatcagttggtagacatagattttttccatttttgatgattatgaataatattgattaacatttatgtacaagttttctgtggacatatttttatttctcttgggtgtatatctagaagtggaattactggattacatggtaaatgtatatgtaaccttttgaggaattgctaactgtttttcacagtggcagaattattttccattctcaccaccaatgcatgatggctttaatgtctccataaccttgtcaatggttgttatcctatgttttttgattacagccagtgtgagtgaagtgatatctcattatgatttatatttccttcatatctaacaatattgagcattcttatgtgctaatttcccattatatattttcttagaaaaatttctattttgatactttgcccattttgattatttgtcctccttttatggacttatgcatttaataaatttttgacataagtcccttgtcacatatatgatatccaagtatattatcttatttttttggttgtctttttactttcttaatgatgtccattgaaacacaaaaatattaattttgatgaaatcctatgaatcaacttgaattgggtcacttttatttttagtgtcatatctactaaactatccccaaatgcaaaatcatggacattagcaaccatgtttcattattagagttttacagttctattgcttacatttagcttttaacttattttgagttaatttttgtaagtggtttgaggtagggggccaacctctattatttcgtatatggataatcagttttctcaattacatttgttgaataatctattctttgactcattaaattgggcactttggtcaaaaaccataaatgcgtgagtatattcctagattccaaaatctattacactgatttgtatgcctaccttatgtctgtatcacactctcttgattattgtatattggtatttgtctttaaaagcagaaagtgtaagccttccaactttgttttttattttaaattgtttcagctatttttttttcttctagcttttttttttttttttttttttttttaaggcaggggtctcactacatttcccaggctgaactagaagtcctgggctccagcaatcaatgaatttcagccacctgagtagctggggctacaggtgcatgccactacatctaaattgtttcagttattactgtctcctacatatctacatacattttagaatcagctagtcaatttatgcaagaagttatctgggattttaatagggattgaattgaatctgcataacaatttggggagcagagtatgggcattgtcacaatattaggtgtttcaatacatgagtataagatgccttttcatttatttagatatcatttaatttatttccataatgttttgtagatttcacagggcaagttttactctccttttgttaaatttattgatggccaggcgtggtgactcacacctgtaatcccagcactttgggaggcctaggtgggcagatcacaaggtcaggggttcgagatcagcccgacctacatggtgaaaccccgtctctactaaaaatacaaaaattagccaggtgtggtggtgcatgcctgtaaccccagctactcaggaggccaaggcaggagaattgcttgaacccaggaggtgaaggttgcagtgagccgagatcatgccactgcactccagcctgggctacagagtgagactccatctcaaaaaaaaaaaaaaaaaaaagagaaaaaaattattcacgaactgtatttttgtgctattttaattgtgattgttttaatcgttattttagcctaaatttttattgcaattagggagaaataactttttttttattgatcctatatcctaaaaccttgctttattggtttactgctctaatatttttctagcggatttgtaaatgtttactattataacattatgacaaaagccaataaagatagcttaacttgtttatttctagtatggagtcttttattctttcattttttaaaccaatttatcttatctagaacctctaatacagtgttgaatggaagtgagaaaagccaatttagtctttctccattaagtgcggtgtcagtgtgtgttttatttatagatactatttgtcagtttaaggatgtttctgaaaggtattgcattaatcacatgattttttctgcctttattaaaatgattatgcagttattgtccttattctaatgatattacatattcaccagttttttgagatgttaaagttagtttgcatttctggcataaaattcccttctggttaaagttagtttgcatttctggcataaaattcccttctgtatgtccaaagctttttgcacatgctagggttctgtttgctagtgtgaaagaaaaataaagaatcaagatcctaaagtcactatgccaaagggaaaaaagtttagcttgggaactgagtcacacaaactgtcagaggcattctaaccagagtgattccaccttgaataagtcagacaaggtcaaacctgccaggttacattcccaggggattgagcactcttggttacaagatactcatggttgagggaatgagttaatgatgataattaactaaataaagacccagaacttatgaaaatgtcccaatagtttgaaaacaaaaacttcttaatttaagaattagttttcctttaaaaaactagcccacttgtaaaatcttgctgaaatcaataatacataggaaaataacaatattaatagcctgtcacaagctgatcacaaacctttgtaataaagtacagtattcttaacaacctatataagcaagcactaagtttaaggtaggggtatttctcttcttgctttctgaggatgccctattctgtaatagagtagtctctaacaaactgttaattttactgtactctgcgactcaccttgcattctttcccacatgagatccacaaacccacccttaacgtctgggacaagaccacttttccagtaatattttcctctggtgactctgctgggacctaaatgaggtgagattccaacccaaaggaaatagactatgcaacaccaattggctgatttgggtaagtggtggaacatatttttatactcgaacagagacactgttcaaaatcggtttagaggcccaacttaggacagttagaggcccttctgacagataagaggtttagaggcctttccgaaagctaagggggttagaagcccttcacaacaagaaatgggttcaatgctacaaaatgttaattactactccctttcaattagccctccctgtgctctctgtcattcactaaagactgtctgctgtctgccaattttctgactgctgactatacttactgtttctttgcagagaccttgcttgatggtcctgagatttttaactttcacgttcctcatttgtctttggattagtggccctttacttgtgtgcttcggcatgttgctaaaagacattagagatgaatggctctgcaagatttactttccctatatctagcccattcgaatgaattatttattgtctcatctctcaaaagattaattgaaatttggtacttacaagttttggtccagtgtgcacgatttagcccagtagcaattatgccaatctcccatgggtgaacagctcccagaaggagaactggagatttctttttggaaattctttttcatcccctcactaatcaactgacctttatttcttgattatgaacagcatgatcatgtaagttttaccctacttaccattactatccttaacctggacattcctctctggatgcatatcatttcccttacttagtgtgacatttctttggtcaggccctctattgtagattctctagttcaggtgactcagctcatttatattatgcgactaacaagaatgccagaattaagtcaactactgaatcattttcccttgcttgtttagctctgaaagctcctttatcctttttagtgaagcttgccctgtggcagcactaccttgttcacaaggatctctaccttcacctgctctgctcctgtgtaatacagctttgatcctgaagagttctgagttctccactaggatgtctagtagagcattggaacaaatttcaattaggtgagcttaagaaaaataaattgacatttttatgtaatactgtttggcctcattatgatttggaatatcaagataaatggccacctaatggaaccacagcctttaatattatacatcaacttgatttgttttgcaagtgggagagaaaatgaggtaaaataccatatgttcaagcatttttattgcttagtcaggatgaaactttacagcaagcgtgtgcatgtttaatgaaaggaaggaaagaaaaggaattagatatactagatgaccctttaatgcaagtcccctgagtccaatgggtgcctttgggtggaacagtacctccctgtgtcagctctaatgcttcaggtgcatctccctctgtctcttctagcccttctagtagtcctgtttagacactttcattcccttctccttacccgtctagtctaattttatacctacctcattctgagaggcccagtcctattctgtaactgtcactccctgaggaggccagccttgctagtactacccagagtggagcctcttctcagtctccaaaggaaaatctttgttggcttagagaagtggcaaatggggaagagcgcactataaggtccctttccccatgttttttttttggtcttatgtaaaggttatttctctgaagacccaggaaaatgtatagataaatttgagaagctaatgctgacttataatttgacctggtaggattttcatattttgttatccacatgttgtacagtggaagaaaaacaatgaattttgggattagctagaatacattcagacaaagtactagcctgcaatcctaatgatatctatagaacaaggggtatttcagtgcctgattaagatctaggattgaactatcaaagaaataggagggcttacagaagagagatcatatgattacttggttattaaaagagaggagagatgtgtgaaaaagtctcttaattattataaggtgaaagaaattactcaaggtaaagatgagaatccagcattatttcagggaaatttggttgaggcaattagaaaatatactaaaattgatcccatttcaatggaaggacaaaccttactggggctgtattttataacccagtctgccactgatgtctgtcagaaactacaaaaagcagcctgggtctgcagacatctatgaatcaacttttcagtatggcatttatggttcttaataacagatacatggcagaggaagtgaaaaacttaagagagcctcctaaaaggcacagtttttagctgcagcattaagcttaccaaccacgtgagatcatccttacacttcttagccatggcaaaggaagctggaaggcagaaagccacaagctggggttctaagcactgcaccttgggtgtaaatcaatgtgctcactgtcataaaattggctattgaaagagggaacacccagcactccaaagtgagtctttggcccctgaacaaatgatggcagttcaagagtgacagggccctagagcttctgtcacagctcccattggacaattagccatatctccagaggagcttcgggtaatcattgatgtgacaggtaacaatattaatttccttttggacatgggtgcttcttactctgttttgactcatcataatgggccattatcatcccaagactctgtggtcatggggataaacggacgagctcatagactccattttccctatcctccaagctgctcttcagggactcttgttttttcgcatgcttttcttataatgcctgaatgtcctactccattttcaggaagagatttatgaactcagctgcaaactctggttttcttcagagatcacaaggcagatgattgattgcttttacttgtctcccatgataagggaagaaaaattaataggagacactctcataatatcttgctatctttacttataccctctttgcagaaagttgaaatttaaaaagggaaaagtaactaggcattcactagaattaggttaactaaaaatttctctgcagagctccttactaggcataggaactacagcaagcatcctgaaggagtctcattagagtgtcttttagacaattgctccaaatatgtccacatagtaaagaaaagatgacacagaacaacatacacaatcaagtatacaaccactacttggtagcattaggggaagttccatggatagatgcttgtaggagctataaaaagaagtggttttggaaggaatcaaaatgagacaaagaccttaaaactaggaaaaaaatgtatctacagagttcagggaatttctgctataaaaattaattgtaacaataaattgtaaaaaaaatgacaagaaaagccaaattgtaatgaaagtgatctgcctaggttacagcagaggcaatcaataaattattctgatgttctcacaatgcagaatatgaagaatgtttgcagaaatcaatacctgttgaagattaactaatgaaaaccaaatgaagaaataaccaactatatacaatatacaatagtatacaactatatacaatatacaatagtttacaatagtatacaactatatactatgtataatagtaacatttgcaccaaaggattatagatatagaaaataaatcaaaatgatgttttataataaacatagttcaaatgtccagagatgaaaaatagttcatataatatatgtatggaaaatgacgagaaccataaacataaaaagaaacacatcaattctagaaattagaaataaactcactggttacactaaaatgtaattgataacatgaaataaaatggaactgaatgaatgaacaaaagaacaaacaataacagcagtagaaagaactagtgaatctttctatttttctccctgaatcttgactcatagagccccaataggaatcacctaatactctaggaattgccactaagctgattaaaatataaaagtgttatttgttaaaaaagaaaaaaaagctgaattagtgctctcccgattgcctgctttattcccaaaactctcttatttctaattgttttactggtcttaatcattcatgctatgtttcactgaagtatttgtgaaatatttcatgtgtttatctcaattttgattttatctcaattttggtttcattctatcttgactcttgcaacctgcatgtcctcattttactttaccaatccagctccaaagacaaccttctcatagacctaggatttctcattaaatttttaccagtttatctgagcttcattgatcttgtttctctgccaattactctgagccactgtcatcatgacctaaaattttttcacaaattacaaatttaccctttataatttatctgtgtcaaggaagactctgtagacaataccagaagaaaaaaatgtgtgcagtacatgaatgaaaaacctgatgtttcctgactttttgatgattgtcattctaactggtgtgagatgatatctcattgtggttttgatttgaatttctctgatggccagtgatggtgagcattttttcatgtgttttttggctgcataaatgtcttcttttgagaagtgtctgttcatgccctttgcccactttttgatggggttgtttgtttttttcttgtaaatttgtttgagttcattgtagattctggatatgagccctttgtcagatgagtaggttgtgaaaattttctcccattttgtgggtggccagttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataatgtgtaaggaagggatccagtttcagctttctacatatggctagccagttttcccagcaccatttattaaataggatgtggagaaataggaacacttttacactgttggtgggactgtaaactagttcaaccattgtggaagtcagtgtggcgattcctcagggatctagaactagaaataccatttgacccagccatcccattactggatatatacccaaaggactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactatcgcaagaacaaaaaaccaaacaccacatattctcactcataggtgggaattgaacgatgagatcacatggacacaggaaggggaacatcacactctggggactgttgtggggtggagggaggggggagggatagcattgggagatatacctaatgctagatgacgagttagttagtgggtgcagcgcaccagcatggcacatgtatacatatgtaaccaacctgcatattgtgcacatgtaccctaaaacttaaagtataataattaataaataaaaaaatgaaaggacaagagtaggaaagtgtaaaaaaaaaaaaagaaaaacctgactgaatcataaacaaaaataggcaattagattaaaaatttagtatttgctaattaaatcaatgatagatttttatatactttggattggtaaaaattaatatcaccataggggaagaaccaactacctggccactccagtgctgtatagagtggcaatagtagaaagatacacacgggctcaacaaactctctctacttaaaactaaggtagctattactgaaatcaaaaattcaacctgctaatatgtaaattctgatcatacctttagagatcagagaagtgaccagtagtgaggctgcagacacaatgaaacaactctaatctcaccttgttatgaactgtatctgctcctgtgttgaagagcttcatttgcgtaagattttgctttttcttcatctgaattttactatgaggcaatgcacaagattttaacaacctatagatactaactgatatgatttggctgtgttcccacccaaatctcatcttgatttgtagcttttataattccatgtgttgtgggagggacctggtaggagataactgaatcataggagcagtttcctccatacttttctcatagtagtgaataagtcttatgagatctgatggttgtataaagggcaacacctcttgcttgggtcgcaatactcacttgcctgctgccatatcagtttcctccatacttttctcatagttgtgaatgagtcttttgagatctgatggttgtataaagggcaacatctcttgcttgggccgcaatactcacttgcctgctgccatatcaatttcctccatacttttctcatagttgtgaatgagtcttttgagatctgatggttgtataaagggcaacatctcttgcttgggtctcaatactcacttgcctgccatcatatcagatgtgactttgctcctccttcctttccaccatgattgtgaggtctccccagccatgtggaactgtgagtcattaaacttcgttcctttttgaattactcagtcttgagcatatctttattagcagcatgagaaagaccaatacagtaaattggtactaggccatagggcactgctataaagataccagaaaatgtggaagcaactttggaactgggtaacaggcagaggttggaacagtttggtgggctgagatgacaggaagatgtggaaaagtttggaacttccttaagacttgttgaacggctttgaccaaagtgtgataatgatatgaatgataaaatccaggttgaggtggactcagatggagttgaggaatgtgttgggaaatggagtaaaggtcaattgcgctatgcaaagagactggtggcatctagcccctggcctagagatatgtggaactttgaacttgagagagatgatatgaggtatctggtggaagaaacttctaagcagcaaaatattcaagaggtgacagagtataaaagttgggaaaatttgcagtctgaaaatgcagtagaaaagaaaaccccattttctggggagaaattcaagttggctgcagaaatttacataagtaatgaggagccaaatgctaatcatcaagaaaatggggaaagtgtttctggggcttatcagagaacttcacggtagaccctcccatcacagattgtagggaaaagaaagagagatcagactgttattgtgtctatgtagaaagggaagacataagaaattccattttgacctgtaccttgaacaattactttgctgagatgccggtaatttgtaactttgccccagccactttgcctcagccactttacctcagccactttgccccaactttgagctcacaaaagcatgtgttgtatggaatcaaggtttaatggatctagggctgtgcaggacgtgccttattaacaaaatgtttacaagcagtatgcttggtaaaagtcatcgccattctctagtctcaataaaccaggggcacaatgcactgtggaaagctgcagggtactctgcccttgaaagccaggtattgtccaaggtttctccccatgtgatagtctgaaatataacctcctgggatgagaaagacctgactgtcccccagcccgacacccgtgaagggtctgtgctgaggtgggttagtaaaagaggaaagcctctcgcagttgagatagaggaaggccactgtctcctgcctgcccctgggaactgaatatgtcggtataaaacccaattgtacagttgttcaattctgacataggagaaaaactgccctatggcagtaggtgagacattttggcagcaatgctgccttgttattctttactccactgagatgtttgggcagagagaaacataaatctggctacgtgcacatccaggcatagtacctccccttgaacttaattatgacatagattcttttgctcacatgctttttgctgacattctccttattatcaccctgctgtccgacacattcctcttgctgagataatgaaaataataatcaacaaaaactgagggaactcagagactggtgccagtgcaagtccttggtatgctgagtgctggtcccctgggcccacttttctttctctatactttgtgtactgtacagtctccaacgggcattatttttcaaaatacagaccttgtgcggtggtcattccttcctcacagtataattaagacttttacattgtatttagatgaaatggctgcattaattggtcaggcaagactatgaatagtaaaatcgtgtggaagtgacccagatgaaatcattgttcctttaaacaaggaacaggttagacaagccgttgtcaattctggtgcatgacagattggtcttaccgattttgtgggaattattgataatcactacccaaaaacaaaaatcttccatttttaaaaattgactacttggattttacctaaaattaccagacataaacttttagaaaatgctctgacggtgtttactgatggttccagcaatggaaaagtggcttacacaggccaaaagaatgagtcattgaaactcaatgtcactcagctcaaagagcagagttggttgctgttatttcagtgttacaagattttaatcagcctattaacattgtttcagattctgcatatgtagtacaagctaaaaaggatgttgagacagccctaatcaaatatagcatggatgatcacttaaaccagctgtttaatttattacaacaaactgtaagaaaaagaaatttcccattttatattactcatattagagcacatactaatttaccagggcctttaaagcaaatgaacaagctgactcgctagtatcatctgcattcataaaagcacaagaacttcatgctttgactcatgtaaatgcatcaggactaaaaaataaatttgatatcacatggaaacaggcaaaaaatattgtacaacattgcattcagtgtcaagtcctacacctgcccactcaggaggaaggacttaatcccagaagtctaagtcctaatgctttatggcaaatggatgtcacatatgtacctcatttggaaaattgtcatttgtccatgtgacagttgatacttattcacatgttgtatgggaaacctgccagaaaggagaaagtacttcccatgttaaaagacatttattatcttgttttgctctcatgggagtatcagaaaaaattaaaacggataatgggccaagatactgtagtaaagcatttcaaaacttcttaaatcagtggaaaattacacataaaacaggaatcccttatgattcccaagggcaggccataattgaaagaactaatagaacactcaaagctcaattggttaaataaaaaaaaggaaaaagagagtagaagtgtaacacttcccagatgcaacttaatctatctagcacactatactttaaattttttaaacatttatagaaatcagaccactacttctgcagaacaacattttactggtaaaaagaacagaccacatgagggaaaactgaattggtggaaagacatgaaaaataagacatgggaaataggtaagatgataacatgagggagaggttttgcttgtgtttcaccaggagaaaatcagcttcctgtttggatacccacaaggcatttaaaattctacaatgaacccatcggagatgcaaaaaaagtgcctccacagagacagaaaacctgcaatcgagcatcatctactcgccaggtgaataaaatggtgatatcagaagaacagaggaagttgccatccaccaagaaagcggagccaccgacctgggcccaactaaaaaagctgacacagttagctgaaaaaagcctgaagaacacaagggtaacacaaactccagagaatatgctgcttgcagctttaatgattgtatcaacggtggtaagtctccctatgtctgcaggagcagctgcagctaattacacttactgggcctatgtgcctttcccgcccttaattcgggcagtcgtttggatagataatcctattgaagtatatgctaataatagtgcatgagtgccaggccccacagatgaccgtggccctgcccaacctgaggaagaaggaatgatgataaacatttccattgggtatcattttcctatttgcctggggaaggcaccaggattcttaatgcctacaacccaaaattgattggtagaagtacctactgtcagtgccaccagtaaatttacttatcacatggtaagtggaatgtcacttgggtcacaaataaataatttatagcactcttcttattaaagatcattaaaatttaggcctcagggaaaaccttgccccaaggaaattcgcaaagaatcaaaagacccagaagtcttagttcaggaagaatgtgtggctgatactgcgatggtattacaaaacaataaatttggaactattatagactgggccccttgaggccaattatattatgattgtacaggccagactcactcatgttcacaggccccatctgtctggcccactaatctggcctatgatagtgatttaactgaaaggctagaccaggtttatagaaggttagaatcaccctatccatggaaatggggtgaaaagggaatttcatcacctcgaccacagttagttactcctgttactggtcccgaacatccagaattatggaagcttactgtggcctcacaccacattagaatttgatctggaaatcaagttatgggaacaagaaatcataagccatattatactattaacttaaattcctttgcaaagttgtggaaaacccccttatatgctagttgtaggtaacatagttattaaaccagattcctaaactataacctgtgaaaattacagattgtttacttgcattgattcaacttttgattggcagcaccgtattctgctagtgagggcaagagagggcgtgtggattcctgtgtccatggactgaacgtgggaggcttccccatctgtccatatgttaacagaagtattaaaaggagttctaactagatccaaacgattcatttttactttgattgcaatgattatgggccttattgcagtcgcagctactgctgtggctgctgtaattgctttacactcctgtcttcaaactgcagaatatgtcaataattggcaaaagaattcttcaaaattgtggaattctcagacccaaatagataaaaaaattggcaaaccaagttaatgatcttagacaaactgtcatttggatgggagattgacttgtgactggaatatgtcagatttttgtattaaacctcgagcctgtaatgaatctgaatatcactgggacacggttagacaccatctacaaggaagagaagataatattaccttagatatttcaaaattaaaagaacaaatttttgaggcatcaaaatcccagttaaatctggtgccagaaactgaggaaatggtgaaagctgctgatagcctcacaaatcttaaccccgtcacttgggttaaaaccattggaagttccactattgcaaattttgtattaatccttgtgggtctgttctctctgttgttagtctacaggtgtatccagcagttccagagagacagcgaccagtgagaatgggccatgatgacgatggtggttttgtcaaaaagaaaaaggggatatgtagggaaaagaaagagagatcagactgttactgtgtctatgtagaaagggaaggcataagaaattccattttgacctgtaccttgaacaattgctttgctgagatgctggtaatttgtaactttgcccagccactttgccccaacttcgagctcacaaaaacatgtgttgtgtggaatcaaggtttaagggatctagggctgtgcaggatgtgccttgttaacaaaatgtttacaagcagtatgcttggtaaaagtcatcgccattctctagtcttgataagccaggggcacaatgcactgcagaaagcgcagggacttctgccgtggaaagccatgtattttccaaggtttctccccatgtgatagtctgaaatatggcctcatgggatgagagacctgactgtcccccagcccgacacccatgaagggtctgtgctgaggtggattagtaaaagaggaacgcctcttgcaattgagatagaggaaggccactgtctcctgcctgcccctgggaactgaatgtcttggtataaaacccgattgtacatttgttcagttctgagataggagaaaaaccaccctttggtgggaggtgagacatgttggcagcaatgctgccttgttattctttactccactgagatgtttgggtggagagaaatgtaaatctggcctacgtgcacatccaggcatagtacctccccttgaacttaattgtgacatagattcttttgctcacatgtttttctgttgatcttctccttattatcaccctgctctcctactgtattcctcttgctgagataatgaaaataataatcaataaaaactgagggaactcagagactggtgccagtgcaggtccttggtatgctgagcgccagtccactgggcccacttttctttctctatactttgtctttgtgtctgatttcttttctcagtctctcatcccacctgatgagatataaccacaggtgttgaggtgctggccaccccttcacacctatggatatatcttgacaggtgggtcacacaaattgggaaaatttgcagtagaaaagaaaaccccattttctgggcagaaattcaagttgtctgcagaaatttatgtaagtaatgagaagccaaattctaatcatcaagaaaattgggaaaatgtttctggggcatatcagagaacttcacggcagaccctcccatcacaggcctggagtcctaggaaggaaaatggtttcacaggccaggcctagggccccccatgctctgggcagcttcaggacatgatgtccttcatccaagctgtttcagctccagccatggctaaaaggggccaaggtatagctcaggccattgcttcagagggtgcaagccccaagccttggtagcttttctggggtgttgagcttgcaggtgtacagaagtcaagaactgagttttgggaacctgtgcttagatttcagaggatgtatggaaatacctagatgtccaggcagaagtttcctgcatgggcgggaccctcatgcagaaactctgctagggtagtcagaagggaaatgtggggttgaagtcccaacccagtgtcgccactggggcaccacctagtagagctgtgagaagagggccaccatcctccagaccccagaatggtagattcactgatagctttcactatgtgcctagaaaagctgaagacactcaatgccagcctgtaaagtagcagggagggaggccctaccctgcaaagtcacaagtgtgaagctgcccaagaccatgggaacccactacttgcattagcgtgacctggatgtaagacattaagtcaaaggagataattttggagttttaatatttgactgcccctctggattttagattcacatgaggcatgtagcccctttgtttttgtcaagttctcccatgtggaatggctgaatttacccaatgcctgtactcccatgtattgaggaagaaactaacttgtttttgattttacaggctcataggtggaaggaacttgccttgtgtcagctgagactttggactgtggacttttgaattaatgctgaaatgaattaaggctttgggggactgttggaaaggtatgctttgttttgaaatgtgagggcatgagatttggagaggctgagggcggaatgatatggtttgtctccacccaaatctcaccttgaattgtagctcccataatttcatgtgttgtgggagggacctggtgggagataattgaatcatgggggcaattttttccatactattcttgtggtagtgaatgagtctcaatagatctgatttttttttttttttttttttttgagacggagtctcactctgtctcccaagctggagggcaatggcacgatctcggtttgctgcaacttccacctcctgggttcaagccattctcctgccccagcttcctgaacagctgggactacaggcacatgctggtacatccagctaattttttgtattttttttttagtagagatggggttttaccatattgcctgggctggtctcaaactcctgaactcaggcaatccgcacacctttgtctcccaaagtactaggattacaggtgtgagccaccacacctggcctgatctgatgattttataaaggaaacccctttcatttgggtctcaatgttctcttgcctgccaccttgtgatatgtgaatttgctccttcttgccttctgccatgattgtgaggcttccccagccatgtggaactgtgagtctgttaaacctctttcctttataaattactctgtattggatatgtctttattggcagcacgagaacagactaacacagtaacaaatgagaaatttataatattgttgtctgctataccacttttcaatttgttgaaggtggagatttttaagcagtaggaaatccttagatggttattacaaaataggatgattataatgaaaattaatgtgcttaaaataaaggttttaatacaatatcatcagaagttgggagaattaatggaacccctagaaagttcccgaaccctcagacttccaagccaatctgctccatttatcacagtttggagtagtttacaaagcacaaatgcagaaatcacaatgtgaaaatttattaacgctttcctcagataatattgagatattaatcaagataaaagtttgcaaaaaggcaagcgtctcttggctcaatcaccttgtacagacacaaaacacattaagtcctaatagagcctaagtaaaggttaatgaaatgaagataaaaggttatagaaaagttggtatatatccacaagctttatgtgaagtagttacatctcttttatctgacagtattattagaatggacattgtatctaactgggaaatgtttcccacatctagtattatacaatggaaggcatccaaatttgtctttaaatcattatgaattgggcattctaaatagaagccagtaagatattccatccaagttcatacagtgtagaatagaagctggagtgctgatagaaaaaaattctctgttcgatagccctatatcaagcataacttatagtaatatgctgtgagtatctcccagtgataaatactgggatttgggaaaggagaatttccacttgagtggcatttactaccttgctgtagtacattaattgaagctatccataacagttcatcaaataaccttgaaacatgaaatacccatgatgtcttgcataatgtaaatgaaacactccagtcatatagcagtacccagaagagttttgtactacaatggaaattgtctatatagaatcaaactgcgtcatgaatgcctgaaggagatattcttaagctcagaacccctttcctcctaggactgattctgaaactgtgtgaggagttgcctaattccacagtgctctataaatagctcacaactgactgacaaagatctgctaggcttgtagatggcacttacagggtgaatgaacaaactactgccatattgattctttttttctagttcttatgtaaatcctttttaaaaaaagggtttttttttttttttttttttttttttggaatggtctcactctgttggccaggctgaagagcatacaattacagtttactgcagcctcagcctcaaactcccaggctcagatgattcaccaacttcagtcccccaagtagctgggactacaggcatacatggccatgcctgacatttttaaaaagctttatttgtaggtatagggtctcactataatgccctggctggtgttgaactcctaggcttaagtccttctctcaccttagcctcctagaatgccaagattataggtgtgagctgctgctgtatctggtctgtaaatccttttttctgtcttcatcatttattggcttccttggaattaagggattatcttgttgtatgtttttatttcttcctttttatttttagggtatttattataggtgttctgtgcttatcataaggcttacatgaaaacaccttcttttttattatactttaagttctagggtacatgtgcacaacatacaggtttgatacataggtgtacatgggccatgttggcttgctgcccccatcaactcatcacttacattaggaatttctcctaatgttatatccctcctccagccacccacccccaacaggccccagtgtgtggtcctctgccctgtgtccaagtgatctcattgttcaattcccacctatgagtgagaacatgcattgtttggttttctgtccttgtgacagtttgctgagaatgatggtttccagcttcatccatgtccctgcaaaggatatgaactcatcattttttatggctgcataatattccatgctgtatatgtgccacattttcttaatccagtctatcattgatggacatttgggttggttccaagtctttgctattgtgaatagtgctgcagtaaacatacgtgtgcatgtgtctttatagtagcatgatttaaaatcctttggatatgtacccagtaaagggatcgctgggtcaaatggtatttctagttctagatccttgaggaatcgccacacagtgctccacaaaggttgaactaatttacactcccaccaacagtgtaaaagcgttcctatttttccacaccctctccagcatctgttgtttcttgtctttttaatgattgccgttctaactggtgtgagatggtatcttattgtggttttggtttgcatttctctgatgaccagtgatgatgatcattttttcgtgtatctgttggctgcatagatgtcttcttttgagaattgtctgttcgtatccttcacccactttttgatggggttgcttgtttttttcttgtaaatttgtttgagttctttgtagattctggatattagccctatgtcagatgcgtagattgcaaaatttttctcccattctgtaggttgcctattcactctgatggtagtttcttttgtcatgcgcaaaagctttttgtttaatttgatcccatttgtcaattttggcttttgttgccattgctttttgtgttttagtcatgaagtccttgctcatgcctacatcctgaatggtattgcctaggttttcttaaagggtttttatggttttaggtctaacatttaagtctttaatccatcttgaattaatttatgtgaaaagtgtaaggaagggatccagtttcagctttctacatatgtctagccaattttcgcaccaccatttattaaatagggaatcctttccccattgcttgtttttgtcaggtttgtcaaaaatcagatggttgtagatgtgtcgtgttatttctgatgtctctgttgtgttccattggtctacatctctgctttggtatcagtactatgctattttggttactgtagccttatagtatagtttgaagtcaggtagcaagatgcctccagctttgttatttttgcttaggattgtcttggctgtgtgggctcttttttggttctatatgaattttaaaatagtttttttccaattctgtgaagaaagtcattggtagcttgatgggaataccatcaaatctataaattaccttgggcagcatggccattttcatgatatttattctttctatccatgagcatggaatgttcttccatttgtttgtatcctcttttatttcattgagcagtggtttgtagttctccttgaagaggtccttcacatcccttgtaagttggattcctaggtattttattctcttagcagcaattgtgaatgggagttcactcatgatttggctctctgttggtctgttattgatgtttaaaaatgcttgtgatttttgcacgtccattttgtatcctgaaactttgctgaagttgcttatcagcttaaggagattttgggctgaaaagatgggtttttctaaatataaaatcatgccatctgcaaacagagacaatttgacttcctcttttcctaattgaatactctttatttctttctcttgcctgatcaccctggccagaacttccaacactatgctgaataggagtggtgagagagggcattcctatcttgtgctggttttcagagggaattcttccagtttttgcccattcagtatgatattggctgtgggtttgtcataaatagctcttagtattttgagatacgttccatcaatacctcgtttattgagagttttagcatgaagagttgttgaatttcattgaaggtcttttctgcatttattgagataatcaagtggtttttcattggttctgtttatgttatggattatatttatttatttgcatatgttggaccagccttgcctcccagctgacttaatcatggtggataagctttttgatgtgctgctggattcggtttgccagtattttattgaggatgttcgcattgatgttcttcagggatattggtctaaaactctgtttttttgttgtgactctgccaggctttggtatcaggatgatgttggcctcataaaattagttagggaggattccctccttttctattgattggaatagttttagaaggaatggtaccagctcctctttgtatctctggtgaaattcagctgtgaatccatctggtcctggactttttttcattggtagcctattaattattgcctcaatttcagagtctgtttctggtctatgcagagattcaacttcttcctggtttagtcttgggagggtgtatgtgtccaggaatttatccatttcttctagattttctagtttatttgcgtagaggtatttatagtattctctgttggtagtttgtatatctgtgggatcagtggaggtatcccctttatcattttctattgagtctatttgattcttctctcttttcttttttattattcttgctagtggtctatcaattttgtcgatcatttcaagaagccagctcctggattcattgattttttggaggtttttttttgtctctatctctttcagttctgccctgatcatagttatttcttgccttctgctagcttttgaatttgtttgctcttgcttctctagttcttttaattgtgatgttagggtgtcaattttagatatttcctgctttcttttgtgggcatttagtgccataaatttccctctacacactgctttaaatgtgtcctagagattctggtacattatgtctttgttctcattggcttcaaagacatatttatttctgccttcgtttccttatttgcccagtagtcatgcaggagcaggttgttcagtttccatgtagttgtgcagttttgagtgagtttcttaattctgagttctaatttgattgcactgtggtctgagagacagtttgttgtgatttctgttcttttacatttgctgaggagtgctttacttccaattatgtggtcaattttagaataagtgggatgtggtgctgagaagaatgtatattctgttgatttggggttgaaagttttgtaaatgtctattaggtcttaaacttaaagtataatttaaaaaaagaaagtaaaaagatgataatccacttcatgaaaacacacaaaattatataactcactcatagagccaacagacaaaggagaaagaaaaaagaatcaaactttatcagtatagaaaactaccaaactgtcaaaaataagtaataagagagaaattaaggaataagggttatacaaaataaacagaaaaaataaaagaataagcctttacctataaatacataaataaataccttgaaaataggtggattaaattatacaactcaaaacatagactaatggattaaaaaacaagacccaactatatacagcctaaaagaaactcatctcacctataaagttacacatagactgcaattgaaaagatgaaatagatatgctatgcaaacagaaacccaaatcaagcagaaatagcttcacttacataagcaaaacacaaactttaagccaaaactttaaggagaggaaaagagagacttaatatgataataaatgaatcaattgttcaaaaagacaaaaatgtaaatatatatgcaaacaaccatgaaccattgagatatatgaagcaaatattattatacctgaaaggagagatggacctaagttcaataatatttgaggatgtcaccaccaccttttcagcattggacagatatttagacaaaaaatcaatagaaacacatgagatttatactgtaccatagaccaaatcgaagtaattgacatttacagaacattttatccaacagctgcagaatataagattctttttatagcacatataacatccccagaattaaccatatatgaggacattaagcaagtctcaacaaattttaaaaaataaaaattttactaattattttatctgaacacaatgaaataaagtataaaatcaatgacaagacaaaactagaaaaatccatgaaaatttaacaacgtattccttataaccaataggtaaaaaaagaaacaattttaaaattacttaaaacaagaaaaattacatcatgcgatagcaaaatgtatgagattcaacagaagcactattaagagacaagtttagaacaagaaatgcctacatgaaagaagtagaaaagtttcaaataaacaacctaatgatctctctcaaagaactctaaaaataggaacaaaccaaaaccaaaattagtgtaagtaaagaaatactaaaaattagagagaaaaaatgaaattaagactaaaaaagatgaaacaaaatgctaacttttttaaaagacaaaatcagcaaggcattgactagactaataaagaaaaacaagaaaatatccaatttaataaaatcaaaaacagaacaggaaacttcacaactgatacagaaatacagcacatcattaaagattgtaatcagcaactacacaacaaatttgaaaacctggaagaaatggatacatttcttgacatatacattagactaagataaaaacaacaaaaaatataaatcttgcacagactaatactgaataacaacattaaatcagtaacaaaaagccctccaataaataaaagtccaggactacctggagtcacaactgtattctaccaactttaaattattatgctaactacagaaaccagttacaaaaaacacatcttgtgtgattccatttatatgaagccctcaaaattggaaaatgtatagagacagaaagtagattagaggttgtccagggttgagggataaggagatgctaaggatacgaggttagttaaggatgatgaaataatgtaaaattgaacatcacgatagtcacacaaattctgtgaaaatacaatgagccactgaattgtcttggctttaaattagtaaactgtattatatgtcaaatatatgtcaacaaaacttttacaaaacaaataaacaaacatcccttggaccatgatatctaagaaagtctgattcagctgtgtaagtactttaggcctacgccaagcagactgcagacacaaagcacctcttgctatccactgttcataacatgattctaaactttcttatatcacataggtgatttgtatttgcaagataatcagaacttaaatggggaaaagcatttgtaattgttaaaagagatattaaacacatcatataacacaaggtcatctagatttcactttttccacttgccatgaagatactctgaccattcaaataatgtacttacattgatatgtagtagttatattttaaattcttgacaatctcttctttaatataagcaagataaatggtacagggataaaatttgaaaggaagtaccgcatttaatcaggatgtctatgaaatgaatttcagctctactatagctactgctgagttttttcctcaactctggaagtcgtgaaaaggtgctgatgtagctatggaatacagtcattggatcgatttagaggcaaaactggatgaacttatccagatgaatcatgagatcattgtgagaccatcggcttccatttttcttgatctcagcaaaccatttgctattaccttggaatttaattctatatctttattgaaagaaaacttaaaggattattgtctcagttaataaatataattggtggaaagatatattttagacatttatttcattcatcaaaaaatattttgcaaatattttgtttattttaaaagctctgtcagatgttgttttacaaatagaaaagtatcgcaggcttatggattggaaaaataaatattgtgaaaatgaccatactgcccaaagcaatctacagattcaatgcaatttctattgaattatcaatgtcatttataagataattataaaatataattctaaagtttatatggaaccaaaaaaagaacccagattacaaaggaaatcctgagcaaaaggaacaaagctgatggcataacattacctatcttcaacatatactacaaaactgtagtaaccaaaacagcaaagtactggtataaaagtagacacatagaccaacagaacagaatagagaacccagaaataaagccaaatacttaaaaccaactgttcaacaaagcagacacaaacatgcacaaaggaaaggacactctattcaaaaaattgtgatagaaaaaaaggagagccacatgcagaagcgtgaaactggatgactatctctcatcatatgcaaaaattaactgaaggtggattaaagacttaaatgcagaagaaaatataagaaatactcttttggacattgacctacacaaagaatttatgactaaagacacaaaaagaaaagcaacaaaaccaaaataaagaaatgggactttaaaaagcttctgcacagcaaaagaaataatcaatagagtaaacagacaacgtacagaatgggagaaaatatttacaaactctatatctgacagaggattactaatcagaatcaacaagtaactcaaacaaatcagcaagaagaaacaatcttataaaaaatgggcaaatgacatgaatagacatttctcaaaagaagatatacaaatggtcagcaaatatggaaaaaagctgaacatcagtaaccatcagggaaatgcaaattaaaaccacaatgagatatcacctgactaatggtatactcttatcagaatgattgtattttaaaagtcaaaaaaagtagatattggcgcagatgtggtgaaatgggaacatttaaacactgttggtgggaacataaactagtacaacctctgtgaaaaactgcatggagatttctcaaataactaaaagtaggtaaaatatttgatccagtaatcttactaccagttacctacacaaaggaaaggaagtcattatattaaaaagacatctgcactcatatgtttattgcaacaaacttcacaattccaaagatatggaatcaacctaagtgcccatcgacagatgagtgaataaagaaaatgtgatctatatatcacatggatatacacggccacatctcacaggaaaaattccagatcatccatgggaacttccccttacctcagcgcctttggggactttgaccaaaactaggaaggctgcatcagtagggaaaagatgctttccttttcctgtgcttcagctccttgctgggagtctacatgggttttgtacacagtttccaggagggcaactcctagagtgcagtagcctgctgccactgcgaagccctgatcctgggcatctataagcagggcctcaactgccaagccagtggtatgagctgccaccagcagtgcaaggattgcctgtaagttgagcaccagtgcaggccccagagtgtgggcctggaggagtctccacgtcaccctcacacactcatacccaccatcatcccaccttcagcttctccctgccctgccatggcaaacgagactcccagcctccagagattcatgaggaggagatgcagatggtgaaggatggggtgtttgacaactgcttgtaattgatgctatgattggatcaaggactcattcctgccttggagaaaagacttgaaccagagcagggagcctgggggtgctgggacagaaggttggggctgagggcagaatgtgatggtggcatgcagctaagggcagggccagggcaggcgtccctaaggttgtaccaacttttgtgaatatttgtattttcctcatggaataaaaaggctcatgtaattaatctccatatatatatacatttatatatgtgtatatatacatttatatatatataaatgtatacacacacacacacacacacacagaaagagagtagtatatacatacacagcatacatgcatatatattcccttttttctgggagtttttccactcatttccattcaccaaagcaatgcctttgtgccatgtacgtgaagaaatattcgtctgctctagcaaagacctcatctggcacagaagctgtcagggaaacaactacttggttgaatttgcaggagggaaaaggggagacttctttgagatccctggtttttttaatgaagactttatatggcttaccctgtgagaaatgttaaatttctggacaatccttggctaaccagatctgtatattagtacgttccaagttgttcagcagaacagcagacaaattacttttatttttaatttcaatactctttgctttagaaacaattttgctgtggcacttcctagtctgtgactctgtcttgaaaagggctggaactcaggctgcgtagacatacatatttcatttatctggtcttcaacttaaacattcacctctttataaaaacttctctgtaattctgaaggtaattcccctttttttgatggagttcaaaaattgctgacttgcactgttgggaaatcatcactgactgtgatttcattttccatactttcatatttacatccacctgctttttctgttcagtgggagacaagcagttggagccaaccttctgagcttcttcaaaaaggctatcaacaaaatattcacaatttgttgattatcactgagagattgattgtcagatactgtttcacaaacccatcttcttttatactttcgagattatctacctctttcattctcttttgtcttattctgggcagggtctcctggcctcagcctcactcagctcagaggccacgagcaccctttggccccgggctccgtctggagcccgctgctccagacctccttaggttccgccgcggcacagctaggatcctgacggactctctaggtctctgccaggcaccagacaccaaaagcatgctgatgtagtctcaattgatttgtttttaaattggtaattaaacctccacctttattgaaagatcatttggaagattttgttctcatactcggtcagttaataaacatatgatttgtcaaaagatagattttagaaacattttatgaattcaaaaaatttgagggaaatatttgggttgttttagaagctctgtcaagatgtagttttaatcaagaaacttatgtcaaaagtttaagaatcaagccttaatattattcttgcagatgtccttggtaaaatctgctggtggggataattaaaatacacattgtatatactttgtatttcctttttggccttttttttttttttaatggagtctaactgtcacccaggctggagtgctagagtgcagtggcacaatcttggctcaccacaacctctgccttccagatggaagcaattctcgtgcctcagcctcctgagtagctgggactacaggtgtgccccaccacgcctggctaatttttttgtatttttattaaagatggggtttcaccatgttggccaggctggtcttgaactcctgacctcaggtgatctctctaccttggcctcccaaagtgctgggattacaggtatgagcccctgtgcccagcccagtgtggagcttctattcactcctttctatgtacctgtggttctgtcagaattaagtgatcaaataacataaatggagatggtaaaaaaatgtgataagacatcagaaagatagtgggatagaaagccagcaactcatgtctccccttgcaacaataagaatttttcacacaaccacagataaaagactctttagttttggtattcaggtaggatgttgtgaaacccctgtgtagcccaagacctagcaagggcattttgagaatacataacagaactcaggtattagactcacttataatgccagaaacagccccatttcccaaaaagcttgtctacagccctgtttggccttgagcctgtaatcaaaattatcttcccaggagtccaggaggaatcatactcactagtgccttagcagaaaagcttatctgtccaccaacattggtctcagcagcagaattgacagttatcctgtaactcaggggaaaccccttcagttgtggtgccagattattactgcttgggcaaggacatagaagcagatttacccatgtctttcagtccagtaattacctgttcatctgagtgtgtgacaggcctgtcaatcttcattcaaacacaaattatgaggaagcctagtttcagctctagcccttctggctgcagttggagaactatcctacccacataggaaagtgctgggggttgcttgtccacctgctaatgaggtcggctcaccatcctccttctgcagtaagtccctagggagcccagccccagctccaaccttcctttctgcagtcagggaccttccctgctcgtgcagaaaactattgggaagcacatttgcctgggccaccatccaggctcaccagtctctgctcccagagcatattctgggagtgggaagggcagtctcgactcaaacccctcttgctacattcaaagaactgcttctacttttcaagaaagacaaaagagacaagagacaaaagagcagaaggctattcaaagaaataatagcggaaaactttcataacttggagaagatataaacatccaggtagagttaggtaaaattaaccgataagatacaacataaataagattactctaatatatattataatcaaactctcaaaagtcaaagacaagctgctgaaagcagcaagataaaagaagtaaaatgcatgtaaaggaattacaagacatctggcaacagacttctctggagaaaccttgtcagccatgatagtgtcagacaatacattcagagtacctaaggcaaaacaaaacaaaacaaaacaaaacaaaacaaaacaaaacctgccaatcaaaaatactgcatccagtattagaaatgctatcctttagaaatgaagtagagataaagactttccagacagactgagtaaatctagcatcaccagacatgtcctacaagaaatacaaaaatgagttattcaaactgaaggaaaaagatgtttttgcataacaagaaatcatctgaagacagaaacttcactggaaaatgtaagtaggaaggcaaattcagaatactctaatactgtaattgtagtgtgtaaaccacttacatcttcagtataaatactaaaagacaaaacaataaaaagtaataataactacaaaaatttattaagagattggaaatataaaaaatgtaaattgtggcatcgaaaacttaaaatacaagggaatattacagttaaagtatacaggggttttttttgcttctctttcaaatcaaagataattgtattggtttaaaataactttttataagatatttttctctccattccaagatggctgaacaggaacagccccggtctgcaactcacagcatgatggatgcagaagataggtgatttctgcatttccaatggaggtacctcgttaatctctttgggactggatggacagtgggtgcagcccacggagggtgagctgaagtgtaaggggtcagggtgtttccctttcctagcaagggaagctgtgacagactgtacctggaaaaatggggcactcctgcccaaatattgcacttttcccagggtcttagcaactggcagacaaggagattctctcccgtgcctgacttgggggggtcccatgcccatggagccttgctctctgctagcacagcagtctgagatcaaattgtgaggcaacagcctggctgcaggaggggtatccatcattgctgaggcttgagtaggtaaacaaagcagccgagaagcttgaactgggtggagtgcatggaagttcagcaagccctactgcctctagactccacctctgtggacaggacatagctgaacaaaaggcagcagacaacttctgcagacttaaacgtccctgtctgagagctctggagagagcagtagttctcccagcacggagtttgagctctgagaacagacagactgccttctcaagtgggtccctgatccctgtgtagcctaactgagagacatctcccagtaggggccaacagacacctcatgtaggtgggtgtgcctctggtacgaagcttctagacgaaggatcgggcagcaatatttgccgttctgcaatatttgctgttctgcagcctccactggtgatacccaggcaaacggggtctggagtggacctccagcaaactccaacaaacctgcagctgagggacctgtctgttagaaggaaagccaacaaacagaaaggaatagcatcaacatcaacaaagaggacctccacaccaaaaccccatctgtaggtcaccaacatcaaagaccaaaggtagataaaaccacaaagatggggaaaaaccagagcagaaaagctgaaaattctaaaaatcagaatgctacttctcctcaaaagtatcacagctcctcaccagcaacagaacaaagctggacagagaatgactttgacgagttgatagaagtaggcttcagaaggtcgttaataacaaacttctctaagctaaaggagcatgttcaaacccattgcaaggaagctaaaaaccttgaaaaaaaggttagacaaatggatagttagaataaacagtgtagagaagaccttaaatgacctgatggagctgaaaaccatggcacgagaacttcgtgatgcatgcacaaggttcaatagctgaatcaatcaagtggaagaaagggtatcaatgactgaagatcaaatttatgaaataattgtgagaagacaaggtaagagaaaaaagaagaaaaagaaatgaacaaagcctgcaagaaatacaggattgtgtgaagaggccaaatatacattagattggtgtacctgaaagtgatagggagaatggaaccaagttggaaaacactcttcagtttattatccaggagaacttccccaacctagcaaggcaggccaacattcaaattcaagaagtacagagaacaccataaagataatcctcgagaagagcaaacccaaggcacataattgtcaggttcaccaaggttgaaatgcaggaaaaaatgttaagggcagccagagagaaagatcgggttacccacaaagggaagcccatcagactaacagcagctctctcagcagaaactctacaagccagaagagggtgggggtcaatattcaacattcttaaagaaaagaattttcaacccagaatttcatatccagccaaactaagcttcataagtgaaggagaaataaaatcctttacagacaagcaaatactgagagatcttgtcaccaccagaactgccttaaaagagctcctgaaggaagcactaaatatggaaaggaacaactggtactagccactgcaaaaacatgccaaattgtaaagaccattgatgttaggaagaaactgcatcaactaacaggcaaaataaccagctaacatcacaatgacaggatcaaattcacacataacaatattaaccttaaaggtaaattggctaaatgccccagttaaaagacaaagaccggcaaattgaatagagtccagacccatcagtgtgctatattcaggagacccatctcacgtgcagagacacacataggctcaaataaagggttggaggaagatctaacaaccaaacggaaaacaaaaaaaagcaggggttgtaatcctagtctctgataaaacagactttaaatcaacaaagatcaggagacaaagaaagccattacataatgataaagggatcaattcaacaagaagagataactattctaaatatatatgcactgaatacaggagcacccagattcataaggcaagtccttggagacctacaaagagacttaggctcccacacgatagtaaagggagactttaacaccccactgtcaatattagacacatccatgaaacagaaggttaacaaggatatccaggacttgaactcagctctgcaacgagcagacctaatagacatctacagaactctccacccaaaagtcaacagaatatgcattcttcttggaaccacatcacacttgttccaaaactgaccacatagttggaagtaaagccctccacaacaaatgtaaaagaacagaaataacaacaaactgtctctcagaccacagtacactgaaattagaactcaggattaagaaactcactcaaaaccacacaactacatggaaactcaacaacctgctcctgcatgactactgtgtaaataacaaaatgcaggcagaagtaaagatgttctttgacaccaatgagaacaaagacacaatataccataatctctgggacacctttaaagcagtgtgtagaaggaaatttatagtactaaatgcccacaaaagaaagcaagaaaaatctaaaatcaacaccctaacatcacaattaaaagaactagagaagcaagagtaaacacattcaaaagctagcagaaggcaagcaatacctaagattagaacagaactgaaggagatagagacacacaaaaaaacccttcaaaaaaatcaatgaatccaggagctggttttttgaaaagatcaacagcaagtattgtagaacagcaaacattgctgcctgatccttcctctggaagcttcatctcagaggggcacctggctgcatgaggtgtcagttggcccctactcagaagtgtctcccagttaggctacccaggggccagagacccacttgaggaggcagtctgtccatttcagagctcaaacaccatggtgggagaaccactgctctcttcagagctgtcagacagggatgtttaagtctgcagaagcttctgctgccttttgttcagctatgccctgccagcaaaggtggagtctacagaggtaggcaggcctccttgagctgtggtgggctccacccagttcaagcgtcctggctgctttgtttacctactcaagcctcagcaatggcgaatgcccctcccccagccagtctgcctccttgcagttggatcttggactgctgtgctagcagtgagcaaggctccatgggcatgggacccactgagccaggcatgggatgtaatctcctgggtgtgtcatttgctgagaccattggaaaagtgcagtattaaggtgggagtgtcctgattttcctggtagagtctgtcatggcttcccctggctaggaaagggaaatcccccaaccccttgcacctccggggtgaggcgatgccccgcccagcttcagcctgccttccgtgggctgcacccactgtccaaccagtcccagtgagatgaaccaggtacctcagttgaaaatgcagaaatcacccatcttctgcattgatcatgctgggagctgcagaccagagccgttcctgttcagccatcttggttcatcactatagacacgttacaaaggaagatatacaagcagccaacaagcatatgaacaaaaaggtcaatatcactgatcattagggaaatgcaaattgtaaccacagtgagataccactgatcattagataaatgcaaatcaaaaccacagtgagatactatttcacacaagtaagagtggctataattagtcaaaaaatagcagatactggtgaggttgcagagcaaagggaacatttatacactgttggtggaagtataaattagttcaaccattgtggaaagaggtgtggtgattactcaaaaagctaaaagcagaactaccatttgacccagcagtcctattactggatatatgcccaaaggaatatgtatcattctaccataaagacacatgtacatttatgttcattgcagcactgttcacaataggaaagatatggaatcacctaaatgcccatcagtggtagactggataaagaatatatggtacatatacaccatggaatactatgcagccataaaaaagactgagatcatgtactttgcaggcacatggatggagctggagaccatcatccttagcaaactaacacaggaacagaaaaccaaatgctgcatgtactcacttatgaggaggagctaactgatgagaacacatggatgcaaagagacaacagacactggggtctacttgagggtggagggttggggagaagaataggatcagaaaaaataactattgggtcctaggctttgtacctgggtgatgaagtagtctgcacagcaaactcccgtgacaggagatcagctatattagaagcctgcacttttacccctgaacctaaactataagttaaaaaaaaaaaacttaataaagaaacgtaaagtcaaaagttttgtgactattatgtcaaaattatgtgcttatcattttgctgctattccttttttaaaaaatgcatttttttctctctctgtaaaataatggtgttccctttccaatgcaaacatactttcagatcctaatcattggggtaaacattctttttaaaactactgtttacaaaagtaaaaatctgactttgtccatgcagatcatctattgacaagtatttttcaacagcataattttaaccttaagacatcagttttaatagcagtcattacattattattccaggtgattcatgggacacctgagcactctgtataattgaagttatctgtagccacatttaatatgacatgttcaatgtttggtctcacaagctcactgcttagagtcttcttcatccacccaatattgaagtaatgaaatggctgttaatagattcatcactgatctcattctgtgacatctttatcagaataatataaaatcaatgtaagaaattttgtgaaattatgaaaatttagaaaaaaataaatttcatttataaaatctgtgtgctttcattatggttttattctatttatataactcaatgtacatatattatgtttatataaaatctttttatctcattgcatatgtcttttcttccgacacaaaaattgtgatatttttctgttcatcattatgttgcatagtattcaacaatacctgtactatggctgacagtgtaatttaacattttttgataaaacaattgtaatggcatggtacacacattgtatacattttaaatcatttctcaatgtaaaatatttgaattgtctccagtgtttattttatgaatgtctgccacaaatattgaatctgaccatcgtgatttagttgttctctgtatagtttcatatgagtatattatgaagccaatgtctatgtgcatttttataatacttaatacttttccccaagtgtctgattcttttaaaatatgcaaacattatctgagaatctaatgcataatggaaaagcaagcaaatttgtgacaacaattattttatgtaagaaggaattagaggacaggctgcacaactattgacttggattggaacctaccttctgcaaatgaataacaacagctagtattagtatttatcaccattgtactaatagtcattcttgcccttgtcttccttctccacctactctcttcccccttctaatggcaccatcactttcctctattgcgaaaggggaaattttttgagaataaggttagagtgcatagaattttcattggtcctacctctgcctttgtcctttgggaaattaccacatagagcctatgcaattttcattcagcataaacattgggatttaactcgactaagatttcagttttctgttgttgctaataagaaggtagacaaaaagatctcttaagacttatataataaagtagtgaggaatgcttgctttctacttatgtctcaaaagaataacattaaagtaaaatatatgaggttcttttgtttcttcataaggaagatcatcctatatcctggcataattctttgataaatctcagtgtagttttcagatgcaagtggtagacattatttggatcttattatacatgcattgttcattttttttttggtgcttctctgtcaggcagctgtgatgatgagtcccaagtttcccagagatttttactgaggtgtcctataggcgtggcataaggcagaaaacattaaaagggtaaactgacccttttatgctctaagatataaacctctgtgatctcactgacgaaagttttaaatgctagagtgaaagcaagtaaacattggctttggctgagaatattctggtggcacacatttatgtcgttgatgaatagtgtaccttgaaaagccttaacccttacatcgttagcatttcatcttgttcatctgactgcccaaaaatctatatttaaacaagtccacaggggatctgttctctaggactttgctggagaaccttgatgtgttggaaaactgttcctattaatagaaaaattatatctcgagtggctggcatatgttaactaatggatactattaatagtaataacaaaaataaaaaatcattacaatattactactatttgaatcactatgtacgagagacattataagtgttttatctgtattaagtatattttcaacacaacacaataggaagaaattgccattattatagaagtaggcataattatctctatcaacattctagtccacttttccattatctgttgcataaactcatgcaaaatcttctaaatgatctacacttttcacaatctggcctttttgtgatgtaatccattgacaacattgagagctttttaaagaaagggaatctgatcacatctctccatttcttaactctgtgcagtagctccccattgcccttaatagacacttcgatctccttataattatattgcttccacttacctctctagcaacatctgctactttactcagctttttcctgcatactaattagaaatcttaggaactgcctttacttcactacctgcttttctttttttgttttcctctccccctcttcttttcacctattcctgcacattactgaggactcactttaccaatgactttgagatctcttctagatgtttgcttagcattgtgaccttataacacttttagacttttcctttttacttgcttatagtctatctttcaaagtacaacgtaaggcatgagggagcagaaagtgcctacatttcttctctgaaaatcgagcacttatccatggtttatgctgatcacttcataaacattctttgaaggaatgacttatactttttttttactttgcacaatgaaggctttcattgaatcaaccctgttttcagagtctctttagtatccctctttgatatttaatgacactaaagtttacacagttgtgatgatatagaaacatatgagtttctaatggtaggtcgctttactcgacctcccatattttctcttactgtgagtcaaacactctgaataaaaacatatctggccattccttctgaaatgcaaagcaaacaaatcaaacaggagtaaatttaccttaggcagggttttggctggtttacagtggagttcccccacaaaatcgacatttggtaagggtgggtgaagaaattcaaaatcccagtacagttgaatgagccacacttcagctttccccattgtctgaaataatgtacattaataaaataaatgtatacatatctttttatacataagcataacaattttcatatattgcatgttacttatatataaggaaagcaaagtgttcagataattaagaggaaattacatatttaatgtaacataagtatattcacaatcacaaatagttattgaaataagccactatggacttaaatatgcatttgtttcctctctaaagttgcagtagtaaccaatatagatttaaacagctctttgagctccacgattaattcatcttactatacttataaaaacagctttctacaaagcacaaaatctagtttccacaatttatcaagtcagtcccttgatccttggttctccaagtgaactgtgagttttctgagagtatggctgaaatccttgaacatactactgcttctagttcatgttaagattttaatgatattagttgtaaaatacatacatttaaaaatgatagctagtatatattcagaatttattgaaacagagatatgtgctcccccttaacttggcccatattttccctaataaagagaagtagttcaataaaatatagattaaaagcttgaatgttcactttcaacaaggtttcagttcacaaagcaaataatttccaagttgttagtgaactatgaacaaacactagaaacctcaaattttaggtttctgtttctgaaatagagccagtatacctctcaactgtgaaggaatccttctgtttatagagaaaaatattttaatacctaaataagaaaactgaggtacacaaagagaaacaagtttctcaatgctgcattaatagttatgctagaaatatgtgtagctcctcatctaaatgtctgccttcatcaagttgtttattgatatatgtattgccttttttaaagatgaaaaaagtatagtaaaatacttatatagttgcttaaagaaatcataagtgctttactttgtagttttttttttttaattcctgtagtgtcctataggagcgatggccaaagggttctagctgagcctataatatcaacatttctataatatttgtgagattgatagatcatcttacatttgccattcatcatttcatttaaacaacactatcttcttacattatatttatatacgctcaccttcaaaggcaaaaggaaagttagaacttattaaccattgattagaaacatgacttacctagaacttcactgtaaaacttctcccacttctcgtatcaaacatttgaaaccaaaagtcaaaataaagcacatgtattaaatttttaatcctctccacgaatgtcattttaccacttaattcagacagaacagcaggtatgcgggaagtggggaatagaagtcctccactatacttctcaagtgtgtagccaggagactgtcaacaaaggacatgtatttaacatgcctttaacatgctcagctagcagttcaccacaggcaccaagggcatctgcaagaacgacatcaaactttgactcttgtagttttgtcgtaattttcttgttcaaaactacatctttacagagattattaacacagtctgtagattcccaaaagagttcttgtgcttgtgagaaatatgaccaaaatgcatctttctgaagatcgtatatccatctattgatcagtttcacaacaagaccctcaaaattatttttaattagagatgttggataaacctcaaatctaatagcagatgatttactagggtgaataataatggaagccaaagatgacagcacagtcatcttatggcctctccaaacaagttcatccaggattgtctttatattcatccaatggctgtattctgtgggccacactagcacctttccacaactcccagaactaaagtgacaactgagttgtatcaggagaatatttgacatcgatttcatagttctcctggtgcaatgcaatgcttcttttcaaatcgctgtttctttctgtttttctcctacttatatctgaagataaatcaatcaagtgaaagtataactgctacaattcaaagtagtagttaccatataatttctaaattaccataggaattgtctgttaccatataatttctaaattaccataggaatttccagattgtttttcacagtggatgcttcaatttccattctcaccagcaatgtataagaattttaatttcttcccaaccttgccaacacttgggattatatttcgtttgattatagccagtgtgaatgaagtgatatctggttatgctttacctttctttgatatgaaatcatgttgagcatgttttgcctaattttggttgaattatttgtcttcttatggacttgtgtttttaatatctttctgatataagaaccttatcacatatatgatttccttgttttttttttattctttgggctgtccttttactttcttaacggtgttcattgaagcacaaaagtattgattttgatgaagtccaactaatcaattttaatttggttgcttttatttttgattttatatctcacaaaccatttccaagttacaaaaattagtacctgttatttattattagagttttatagttctagtgcttacatttaagtttttgatcacctttgaattagcttttgtaagtgatttgaggtagagggtcccaactcaattattttgtatatggataatcattattcccacttatatttgttgaataatctattctttcccccttaaatagttttgaaacttttgtcaaaaactttaaatgcatgggtgtatttctatattctaaaatccattccattgatctacatgtctatctgtaggcctgtatcacactctcttgattattgtatatttgtatttgtctttaaaagcaggaaatgtaagttttccagctcatttttattttaaattgtttcagttttttaaaaaatttttttcttcttgctttttttctttaagaggtagaggtgttactatattgcccagactagattcaaatttctgggctcaagcaatcctcccaacacagcctcttgagtagctggatttacagatgtgtttcactacacctagcttcttttggctattagtatgtctcttgaatatgtataaatttcagaatcagcttgtctgtttatgcaaagaagtgatctgggattttgatagggattgcattgatttggtatatgaatttggggagtagagtatggtaattatcacaatattaggtctttcaataaatgaagatgtgatgcctttctatttatttagatgttcttatttccacagcgttttgtagattttgttacagtggctagctagtcagacacaaacagggcagaagacggctcccacaccctaccaggaaagtcagatgaccatcagttaatggtcaggcagttgtcacactgtctcgctaaaataataattggttgcagccagccagagaaaggcagctttcctataaatagaaaaaatcaaatctggtaatcagcagcttcctgataagatctcaggagttgggtgagtgggctcacgcatgcacattaagaggccaaatggtggagtaagacattccggtggcaccagaaaagggaagaatgcctcaggggagcattcatatgactccagtaaacatactgtgcatactcatctcctaagtgctagcaggccatcacacataccagcaggtcaccctaaggaaagaatcaaggaaaatggaagcaggatcctggaagtatgccaacatataaaaccctaagtcaaaggtcaaacactgcactttaccttcaaaatggccacttggatataccccaagtgtactttcctttctttcctgctataaacctttttaataaattttcacttttgttctgaaacttgtcccggtctctttttttgccttgtgcccctcaatcaaattctttcttctgaggaggcaagaattcaggttgctgcagaaccacaaaaatttgctgcagtaaccaccactagtaataatttcacagtgagagttgtacaattttttgttaaacttattactaagaattatattttttcatggtattataagggtgattgtttaatcttcattttagtttaaatttccattgcaattttgtagattttttgttttcttatcttggatcccaaaatcttgttttattggtttacttgaatattttttagtggatttgtaaaaatttcctattacaagatcattatatatgccaatagagatagtttaacttctttctttctaatgtggattccttttatttcattttctttcttatttgttgactgaaatttctactgcaatattgagtggaagtgagaagagtcaatttagtgtgatgttagctgtgtatttttttttttttttttttttttgagacggagtctcgctctgtcgcccaggccggactgcggactgcagtggcgcaatctcggctcactgcaagctccgcttcccgggttcacgccattttcctgcctcagcctcccgagtagcagctgtgtatttttttatagatactattgatcagttttaagatgttctcctttacttctagtttaagtgttcttatgatgaagagtattgaatttcattaaataagtttttctgcagttattgaagtgattatgcagttttttcctttattctaatgatatgatatactagttggctttttcagatgttaacataactttgcattcctggaataaaattcatttgtttatggcatttaagcttttcgtatgttcctgaattttctttgctagtgcgaaaggaaagtaaaaatcttgagacattaaactcactatgtcaaagagaaaagttaatcttgggaaacaaaccatgtaaaactggctcccattttgttcctaaacagataaatgcaaaaatagaaggccacatacctctccagagggcctccttcccaatttactcacaaggaaaatcacaaggtcctaaaacagagttctcttgacttttaccctgagagtataaattaacattttatatttgcaggtatataaaagacaggacttgaagccattgtgtggtttttagcataagggcttactgaatggtggttatgttttctcctcttttattttttggaggattaattattttaaatatttgatagaagtatagagctttgatattttctactctaccatttccagttattaccccactatttttttctaaataatatttcactggaagccatcagacactggcttttcttttatgggagactttttccttacagcttcaatcttgttacttgttattagtttgttcaggttttttatttcttcatgggtctatcttggttggttgtatgtgtccaggaatttattaatatcatctaggttttccaatttgttggtatatagttgttcataatattctgtaataatttgtgtttctgtaatctcagttttttgtctcctctttcacttctgattttatttagtgggtctgttctcactttttccaacttagtctagctaacagtttgttgattttgtttacttttacagagtttaccttattgtctgtggctgcttttgtactacagtggaagagttgagtaggaacaagagtctaaagggtttgcaaattccaaaaatatttaccatctgaggctttatagaacctattctgatctctgcaggttcattttttcctttaacctttctatatattcaatatatatttctatatatttctgtattactatatattcaatatattgtatatattcaatgcaattttaataaaatagtatagatttttagtgagtcagatgatttatgtttaattatgttaataatgagttaataaattaatttgtatttccattttatttagaataggtgagtttgtttgttatgtggaatggtgcttctgttttaccttttttttgagaaatctctaaactgctttccacagtaattcaactaatttgcaatccaccaacagtatataagcatttccttttctctggatcctcactagcatgtggtattattattaatttatactttttagtaatagccattatgactagtgtgagatggtctcattgtggttttgatttgcatttctatgatgattagtgatgttgagcatttttgtcacgtttgttggttccttgtatgtcttcttttgagaagtacctgttcacatcttttgcccggtttttcacggggttacttgatttttgcttgttgaattattcaagtttcttatagattctagatattagacctttaacagatgtgtagtttgctaatatttcttcagtttacatctcacttgtgaattttgagttttgttgcaattgttattaaggacttagttataaattctttcccaaggctgatgtctagaatggtatttcctagattttcttcaataagtcttatagctttaggtcttatatttaaacatttaattcatcttgggttaatttttgcttggtgaaaagtagagatccagtttcattctttttcttatggctagcaagctatcccaccatcatttattgaatagggagtccttttctccattgcttatttttgttgactcagtgatagatgactataggtctgttgctgtatttctgggctctgtattctgtttcattgatttatgtgtctgtttttgtaacagaaccatgctgttttggtgtctgcagccttataacatagtttgaagttgggtaatgtgatgcctctggctttgttctctttgctgaggcattcttcagctatttgggctaatttttggttttatggaaatttttgaatatttttttctaattctgtgaataatgacattggcattttaataggaatagcatttaatgtgtggatggctttggttaggatggttattttaatgatattgattcttccaaccctgagcataaaatgctctaccatttgtttgagtcatctatgatttatttcagcagtgctttgtagttcttgtagaaaacttttgtctccttggttagatgtatttttaagtatattttgtttgtgtgtgtggtataaatgtgattgtgttcttgatttgactcttagcctgaatttttattggtgtatagaaatggtattgatttttgtacatggattttgtatcttgaaacattactgaagtcatttttcagttctagcaggctttaggcagtctttaggattttctaggtatagaatcatatcatcaccaaagaacaataccttcaattcttttcctatttggatgccttttatagctttctcttgcttaggtgctcaattaatacattattgaaatagaaagtgctgtcattttaatcatttatatttgaaatataaaattttaaaaatttatatttgaaattttaatcatttatatttgaaacataaaattttaaaattttaaaattttaaaagatttggactatgttaagtccaaattcattgcagaaatgtacttatccatttaataataataatagttatagcaaattgaattttgctatatacagcaattacatacagcaactcttttagtctcagcaatgctattaagtaggtagtgacattgcttcatctacatttcactgaaggagaatgtgaggcatagacctgataagtaatttgcttaaccataagtgattctgtaatggttttgcaaagatgatataggttatctggattcagagtgcaagctcttacccaccatcctatgctgactactctttctgggttacaggtagttacaaaatgtaatatagattcactttttttgtaggtatatattaattttaatattattacaggagtataactcaaatatgtaaaaatatttttctggttgtctatcactgcttaaccaactgctctgaaatgaaggtgcttagaacagcaacattttatcatcatctgttttaattctaggttgttggccaggctcagttaggtgtttatggcacagcatttctcagttggttactgtcctaaggtagcttgggctaatcatctgaaggttaatcactcacatatctggtgattagtattaaaagtctcaagctactgcagtgctgggccaattgtgacttattaggcatacatatgtatttctacaccaaatggtatatttctcctggggactgtggatatagcacagggctccaaagcgagtggagagacagagaaaaaggaaaaaagaatgacagaaacacagagaaaaggacagaaggacagacagagaaaatgtattaacaatttttttgagctttggaagttaagctcctcacttccactatattctcttttttgagacagccacaaaatttgctaaatttcacaggaagggtatatgacttgatgagaggattgccaatgcatttgtaatcacatctcaaaattactgcgaatataaccttaaaaattagaagaaatcactaaactactgtagaattcataaaatgttgacataagacattaaaattttaaaaatttgtttgctaaaattttagccataattaaaaattttaattaacattctaatatatttattaataaatatttaaaatatcaagtaggtgtccaaaaacaggctgtaaatttatcagatagagagcaccggattgctggtcaatttaagttttctaaatggcactaatggattgataatattatattaaaacccaagaacatgctatctcaaatcaatgtttatttcactaattaatttttaaaactatataattaatatataaaaacaaatttgtgaaaggttagtgaatgaagtatatagaatcaaaattaaaagtagaatcctctatgtttatacagatttacagattcttaattttatttcaaagaagaatatcatacttttttttctgaaactttttttcatttagcaatgtgatgtggagagcattccatgatattgtctgtaatatgcctgttctctgtaattgctgcataccttctactttttgtggtaggtatgtatgttcattgactgatagccaggcaagtgatggagggaacatcctgtacatacatgcactcaggtgcaagtatatctggatggcagatgactagatgtagaattgcagagtcaaactgtatgtttaattttttttgtaagagttgtttcactttatactctctcacaaactcttttctcagattcttatgtttgatcaatctcctgtgggaaaataattcgttgactttttatggctacatagtaatccatggtgtatacatactgcactttccttattcagtctaccattgatggacatttaggttgatttcatgtctttgctattgtgaatagtgttgcaatcaacatatacatgcatgtgtctttataatagaatgattatattcctttgggtatatacccagcaatggcattgctgggtcaaatggtatttctgtcattaggtcttggaacagacaaccaaatgctgcatgttctcacttacaagtggaagctaaatgatgagaacacatggccacacaggaagctaagtgatgagagcacatggaacacatgaacaacacacactggggcctcttggagggtagaaggtgggaggggggagaggatcaggaaaaataattagtgggtactaggcttaatacctgggtgttgacacatatttacctatgtaacaaacttgcacatgtacccctgagcttaaaataaaagttaaaataaattcattgacttaaggttattgacttactaaattataatgtccaactttctagtacaagtagccatctttttgatgtgattggccatttttacttctgtgaattgtcaattcatatccttcatctattttcatattggtctgtttgtctttttggttggtgatatataatagctctcactatacaagagataccagtcctttatctatgtgttgcaggataagcttgatgtaaattactttaggtttgtatgcatgatttagcaatattatctactatgacactatattcattcaatttttcttaaaaatgtttcatttatctagatacattttataaaaatgttgctgcaatctcttccaataattcccttagcatcaaaattttaatttatttttagaatacattcatgccataggtcatagagtggttattgtgagacttggatgatggtcttcttaccaataaagacacataggtttgtgttaacccatactactttgatcataaagtgtttccttgatgtgtagcttttaagagggccttgagaattcctgagattttattatttgccaatttttggtaatttttgtggtcttttaattgttactgattatgattagttgcaatatgcttacattttaaaaaatcattatcctatttttggtcatgctaaatgacttatgttttcatattagtgttatgggatgaatagagttacaggcttctgaggaaagagagaaacatgagacatccttatataaaatagggttatatagaataattatcatttttaactgtcttctacaaacacattcagtttcacaaacatctgtaaggcagctcaataattctgtgccttgttttggaagaagtgaacacatatatacatgtacatttgtgataatcaaaatcagtaagtccccttaaagtgctggttttatattatcacaacctacaattcagacattttatccaatattaaagtttaaaaatgaccgtgaaagcaaccagttcacactttagaaaagttcatggggaaaagagaattagcttgtgaacaaaggttttcccaaatagttaaattttgtagtatttgtcaggtaggagtcattctatctctaatttgttgttctccaactccaagtctctgagtcccattattttgctcttcaggccctgaatttggcataaagtgtagtagaggcggacagtgtcgtctcctgtgcatcactgttgttttgcgaagaaattctcaatgtggtcagctgctgctgctacagaagtcgattttctttaaacactgccaagaacatctgacttacatagtatattttgatttgatatttattcaaactgagcctgctttttttctttttacaaactctctaaaactgctaaaagtcttcactttataaactatgtaattaccatgatctttatactgttggtaaagcaatggttcactttccccatgtctttcacctcagttcttttctcccctgtgtgaattgtatccattttgttcaaagtgattttactgaataccaggagttatcacctctcaagtgttattggcaatgagattgtttttgccagttatcagtgaattattaaattccaaagtcccttgttgagggtctgctttttagtgccacttgcccaagctgccatagtctatttttctcagaaagcaaagcctgagataagaattagtgtgcaataacttaatttgagaaatgttcttagggtacaggagtaggggacaggaaagggtgaaacaagaagggagaaaagtcagtacaagaatgtgttaccaaactaatcatcaccataactgttgggactaaagctcatgcggacccagtaggaagttgtgtggatgtaaagcgtgatcattaaccatcactttctattgctcacactgccaggttatgcatatgtgagtgagtgctagctgagtttcttcgagggttccatgaagagatgttaaagaagtctggtgcagaaaatgagagacctgtcctatcagaagacgacttcacaaagctccttgacacagcaaaggctagagaaaaaaaaattagctgaaaaaatatggggtgcaacctaatttgatcaaatgtattagagctttcttttttcttttgtttcattttcacagtatattacttttcatatgattaaatactgtaaattttctcaggtttctgataaagttatgcctgtgatacaggagctagaaagaaattatttaggcagatagtgagggtgaaagtccttggtaaggttttgttttaataaaaagcagccccccaaatcatttccttgctaacaaaaagcagccagaaaaatcaagcttcaaacctagataaacaagctaaagcttgcataggtaaatgctggcaactgtgccagtaattcctcaaggatctagaactagaaataccatttgacccagcaatcccattacttggtacacgcccaaaggattctaaatcattctattataaagacacatgcacacgtatgtttattgcagcactattcgcagtagcaaagacttggaaccaacccaaatatccatcaatgttagactggataaagaaaatgtggcacatatacaccatggaatactacacagccataaaaaaggtaagttcatgtcctttgcagggacatggatgaagctggaaaccatcattttcagcaaactaacacaagaacagaacaccaaacaccacttgttctcactcataagtgggagttgaacagtgagatcacatggacacagggaggggaacatcacacactggggcctgttgaggtgtggtggactaggggagggataggattaggagaaatatctaatggaggtgacgggttgatgggtgcagcaaaccactgtttcacatgtatacccatgtaacaaaactgcagattctgcacatgtaccccagaacttaaagtataattaaaaaaaaaaaagaaagaaaagggatgggataccttgaagccaggtatattcaacatggatattcaacgtggaggtcccctctttccttttctttgtcaaccatatgtgcagtaaagaagcagcaacatggcactggccatgtagagaaaccatttgcttattgaaaattaaggtggggcagacagcttcttcttacactatgtaaatggcacacctggttccaccaatcctttgtgccctatataaatcagacactgtttcctcaagctcatctataaatccctgtgcatttcaccatgggactagaagatccattcgggagcacctttctgcagaaatgagagctattctcctttctctttctttcccctattaaacctccattcttaaactcacttctcgtgtgtccatgttttcagtttccctggagtgagatgatgagttttgagtatttaccccagacaatgatgctgcttaacctgttacttttatttattcttatttttaaaatttttatttattttttatttattttactttaagttctgtgatacatttacagaacgtgcaggtttgtggcataggtattcatgtgccattgtgatttgctgcacccatcgacctatcatctaggttttaagccctgcatgcattaggtatttgtcctaatgctttctgtccccttgtcccagaccccctgacaggccctgatatgtgattttcccctctctgtgtctatgtgttctcattgttcaactcccactaatgagcgagaacatgtagtgtttggttttctgttcctatgttagtttgctgagaatgatggtttctatccatatccctgcaaaggacatgaactcattttttatggctgcatagtattccatggtgtataggtacacattttatttattcggcctatcattggtaggcatttgggttgtttccaagtctttgctattgtaaatagggctgcaataaacatacatgtgcatgtgtctttatattacaatgatttttaatcctttgggtatatatccagtaatgggattgctgggtcaaatggtatttctgcttctagatccttgagcaattgccaaaatgtcttccacaatggttgaactaatttgcactgccatcaacagtgtaaaagtgttcctatttctccaaatcctctccagcatctgttgtttcttgactttttaatgattgtcattctaattggcatgagaaggtatctcattgtggatttaatttgtatttctctaatgaccagtgatgatgagctttttttcatatgtttgttggccacgtaaatgtattcttttgagaagagtctgtttatagcctttgcccactttttgatggtgttgtttttgtcttatatatttaagttccttgtagattctagatattagacctttgtcagagggatagattgcaaaaaattcctccattctgtaggttgcctgttccctctgatgatagtttattttgctgtgcagaagctctttagtttaattagatctcatttgtcaattttggcttttgctgcaattgcttttggtgttttagtcctgaagtcttcgcctatccctatgtcttggtattgcctaggttttcttctagggttcttatggttttgggttttacatgtaagtctttaatccatcttgagttaatttttgtataaggtgtaagaaaggggatcagtttctgttttctgcatatagctagcaagttttcccagttttcccgttgcttgtttttgtcagttttgtcaaagatcagattgttgtagatgtgtggtgttatttctgaagcctctgttctgttccattggtctatatatctgtcttggtaccagtaccatgctgtttttgttactgtagctttgtagtacagtttgaagtcaggtagagtgatgcctccagccgcttttttttgttttgttttgttttgttttgcttggggttgccttggctatacaagctcttttttccttccatataaaatgtaaagtagtttttctagttgtgagaagaaagtcaatggtagcttgatttgaatagcattgaatctataaattacgttaagcaccgtggccattttcatgatattgattcttcctagctgtgagtatggaatattttttcatttgtttgtgtcctctcttatttccttgggcagtggtttatagttctccttgaagaaatccttcacgtctctttttagccatattcctaggtactttattctctttgtagtgcttgtgaatggaagttcaatcatgatttggctctcagtttgtctattatcagtgtataggaatacttgtgatttttgcccattgattttgtatttggagactttgctgaagttgcttatcagcttatgaaatttttgggctgagatgatggggttttccaaatatagaatcatgtcatttgcaaacagagacaacttgacgtcctctctttctatttccataccctttatttctttctcttgctgattgccctggctagaacttccaatacaatgttgaaaaggagtagtgagagagggcatccttgtcttgtgccggttttgaaagggaatgcttccagcttttttgcattcagtatgatatgggctatggatttgtcataaattgctcttattattttgagatatgttccatcaatacctagtgaatggggagtttttagcatgaaggtgtgttgaatttatcgaaggccttttctgcatctattgagataatcatgtggtatttgtgattggttctttttatgtgatggattatgttcattgagttctgtatgttgagccaggcttgcatcacggggatgaagctgacttgattgtggtggataagatttttgatgtgttgttagattcggtttgccagtattttattgaagatttttggatcaatgtccatcagggatattggcctgaaattttcttttttgttgtgtctctgccaggctttggtatcagcatgatgctggcctcataaaatgagttagggagaattccctctttttctgttgtttggaatagtttcagaaggaatggtaccagctcctctttgtacctctggtagaattcagctgtgaatccatctggtcctggactttttttggttggtaagctattgattattgccacaatttcagatcctgttattggtctattaagagattcaacttcttcctggtttaatcttgggagagtgtatgtgttgaggaattcatccatttcatctagattttctagattatttacatagacatgtttatagtattctctgatggtagtttgtatttctgtgggattggtggtgatatcctctttctcattttttatttcatctatttgattcttctctcttttcttctttattagtcttgttagccgtcgatcaattttgttgatcttttcaaaaaaacagctcctggattcattaattttttgaagggctttttgtgtctctatttcgttcagttctgctctgatcgtagttatttcttgccttctgttagcttttgaatgtgtttgctcttgcttttctagttcttttagttgttgtgttagggtgtcaattttagatctttcctgctttctcttgtgggcatttagtgctataaatttccctctacacactgctttgaatgtgtcccagagattcttgtatgttgtgtctttgttctcattggtttcaaagaacatcttgatttctgccttcatttcattatttacccagtagtcattcaggagcaggttgtttagtttacatgtagttgagtggttttgagtgagtttcttaatcctgagttctagtttgattgcactgtggtctgagagactgtttattataatttctgttcttttacatttgctgaggagagctttacttccaagtatgtggtcaattttgtaataggtgtggtgtggtgctgaaaagaatgtatattctgttgatttggggtggagagttctgtagatgtctattacgtccgcttggtgcagagctgagttcaattcctggatatccttgttaactttctgtctcgttgatctgtctaatgttgacagtggtgtgttaacgtctcccattattattgtgtgggagtctaagtctctttgtaggtctctaaggacttgctttgtgaatctgggtgctcttgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggcagatcttcctccatccttttattttgagcctatgtgtgtctctgcatgtgagatgggttttctgaatacagaacactgatgggtcttgactctttatccaatttgccagtctgtgtcttttaattggagtatttagtccatttacatttaaagttaatattgttatgtgtgaatttgatcctgtcattatgatattagctggttactttgctcattatttgatgcagtttcttcctagtcttgatgggctttacattttggcatgattttggagtggctggtaccggttgttcctttccatgtttagtgcttccttcaggagctcttttagggcaggcctggtgatgacaaaatctctgagcatttgcttgtctgtaaaggattttttttctccttcacttatgaagcttagtttggctggatatgaaattctgggttgaaaattcttttctttaagaatgttgaatattggcccccactctcttctggcttgtagagtttctgctgagagagctgctgttagtctgatgggcttctctttgtgggtaacccgacctttctctctggctgcccttaacatcttttccttcatttcaactttggtgaatctgataattatgtgtcttggaggtgctcttctcgaggagtatctttgtggcattcgctgtatttcctgaatctgaatgttggcctgccttgctaggttggggaagttctcctggataatatcctgcagagtgttttccaacttggttccattctccctgtcactttcaggtacactaatcagacgtagatttggtcttttcacatagtcccatatttcttggaggctttgttcatttccttttatacttttttctctaaacttcccttctcacttcgtttcattcatttgaccttccatcactgataccctttcttccagttgatcacatcggctcctgaggcttctgcattcttcacgtagttctcgagccttggctttcagctccatcagctcctttaagcacttctctgtattggttattctagttacacattcgtctaaatttttttcaaagttttcaacttctttgcctttggtttgaatttcctcttgtagcttggagtagtttgatcgtctgaagccttcttctctcaactcatcaaagtcattctccgtccagctttgttccattgctggtgaggaactgtgttcctttggaggagaagaggtgctctgctttttagagtttccagtttttctgctctgttttccccccatctttgtggttttaactacttttggtctttgatgatggtgatgtacagatgggtttttggtgtggatgtcctttctgtttgttagttttccttctaacagacaggactctctgctgcaggtctgttggaatttgctagaggtccactccagaccctgtttgcctgggtatcagcagtggtggctgcagaacagcagattttcgtgaaccgcgaatgctgctgtctgatcattcctctggaagttttgtctcagaggagttcccggccgtgtgaggtgtcagttctcccctactggggggtgcctcccagttaggctgctcaggggtcaggggtcagggacccacttgaggaggcagtctgcccattctcagatctccagctgcgtgctgggagaaccacttctctcttcaaagctgtcagacagggacatttaagtctgcagaggttactgctgtctctttgtttgtctgtgtcctgcccccagaggtggggccttcagaggcaggtaggccttcttgagctctggtgggctccacccagttcgagcttcctggctgctttgtttacctaagcaagcctgggcaatggcaagtgcccctcccccagccttgttgccatcttgcagtttgatctcagagtgctgtgctagcaatcagtgagactctgtgggtgtaggaccctccaagccacgtgcgggatataatctcctggtgcaccgttttttaagcccattggaaaagtgcagtattcaggtgggagtgacccaattttccaggtgccatctgtcacccctttctttgactaggaaagggaactccctgaccccttgcacttcctcagtgaggcaatgccttgccctgcttcagcttacacacagtgtgctgcacccactgtcctgtgcccactgtctgtcactccttagtgagatgaacccggtacctcagatggaaatgcagaaatcacccgtcttctgtgtcactcacgctgggagctgtagactggagctgttcctatttggtcatcttggctcctcctcctaattcttgaagatttcattggctaaagtaaaacaaaaattctgctcaaaatgaagccaaaatattttgagtatttgcaaaacaatgttgatactatgagtggagttcttaatgttgttgtgttcaaatacaatgtgtgaaacataatgaagctcagtaactttcgtgtgtaacttttggattagaataataaatatcaatataagcccataaggttttatattatttttatttttcttttcttttttttttatggcttggatgacactttattttcagatccaatactagaagttgtttccatgttcacattttccttcctggtttaaaaaaaagagttgtattttttttttttgctttttttaaattatactttaagttttagggtacatgtgcacaacgtgcaggttagctacatatgtatacatgtgccatgttggcgtgctgcatccagtaactcgtcatttaacattaggtatatctccaaatgctatccttccccccattgtatttttcatagcttaaaaatcattgacatagaataattcagctaaagtacgtattaaatccctggaaaataaattttgtcttaacaaggtaagttgtgaaaagatgttttgtcacaggaaaaaggaaatcctccatttaaaaccctccatgctgaaataaaggaggagtcccatctttcagtcattccacttcaggcttttgatataactaatctcttttcttcttctttccttttttggcaagctttcggaaacaaaacaggcaaaattttgtgatgataaatatcacagttgccacgcaggccagcaggaatgctatcacatccaaagagtggtactggatccaggtgaggttgtgagctgcgactcgaaggtgcttggctcctttgtggcgcatgacaaactcaatccagaagactgctcgatccaggggcttcattggttggtcatgatgaattcttgataatttcatgacattctctttatagctgaaggataaatataaagatatcaacattaaaagtaaatttattgcttaagcatatcaagtctatggatggtctttgaaaagtgtcacacaaatgattgaaagtaagtgtcactgaattggcatgaaatttcaatgttttaattcatgtcattacagaaagtttggtttttaaattggagttttatcactgacaaatacctttaaaaatgaaaaatggaattttcggtgggaaagttaatgttttctggagcagaaaatattatgagccattctaagtgctataagtaagatagtggaaatggaatttgagaatgatctttttgatctttttaatttttttttattttttgagacaggcttttgctccattacacaggctgagtgcagtcacatgatcatggctcagttcagcctttctctttcggtctcaagtaatcctacatctcagtctcatgagaagctaggactacaactgcacaccaccatgcctggctatatttttttattttttacacttttagatatgaggtgttgctgtagtgcccatactggtctggaactcctgtagtcaagtcattctcctgcctctgcctcccaaagtgttggccctacagacatgaaccactgtgcccagcccattttgacgtatttaaagaagaattgtgacacaactggtgaaatgcctcctaactagtttctcagcttctactctaatcttttgtcttctaccatattttccttctagtagccagaatattttccaaattaatatcaaattatgacactcacctgttaagatttccatctggtttcttgttacattaagaataaattccaaatctgtctttggtctagagaactctacacaggcacctacttgtcctagccctttccccctgtacactttcttctagagacaatggccttcggtttttctctaaactcctgaaggtgttctcaccttagcccctttacaccttttgttccccgtgtctctctcattgagcattctttcttgcaactacttgaggtttgcttctatttctttttgaggcttccccttgtatgatacctcttggagagtcttttcctggccacactataggcacccataggatttctctagtgcttcatgcttactttgctatttgatttctggaactttaaaatatgttgtatatcttctacagtaaaacttcaagtatgaaatacataggataaatgtatatatactatgtgactacctcaaaattttaagattatcttaaacattatcccaaagtgaagacaccaatttatcacaaactgcatagaagaactctctcctcctgggccattttagtcactatttttatcctcaaagtaagtattaacctgatttctgatatcatagattagtattgtttatataattgaattaaataatacatattcatttctgtttttggttagcagttgtttaatagcattggtgtagagagtattcagttgattgacaaagaccacagatgatctcttcattttgtgattaatggatatttgtgttgttaacattttttgaccttactaataattatggtattaagatatttgtatattttattaggtttaaatatttattcatttttgttggatgtatacttggaagaatagttgatgagagaaaggcacatttataattagaattttttgttgactgaattttttaaaaaatattttttattttaaagaatcagattgttttcagttatcgtttttggatgatttataatttatttctagtatgactagaacatataatttttatgaatttgaatctgatacaatttacttagtgtttatttatggcccagcatatggtaaattcaggtaactatttcatataatctttttttttttttttttttttttttgagacagagtctctctgtcacccaggcttgagtgcaatggagtgatcttggctgactgcaatttgcatctcctgggttcaagtgattctcatgcctcaatctcccaagtatctgggactacaggtgctcatcccctacatctggctaagttttgtattattagtggacacaggatttcaccatgttggccaggctggtctcttaactcctgacctcatgtgatcctcccactttggcttcccaaagtgtcgggattacaggtgtgagccaccacacccggtctccataaactcttttaaaaatgtttattttctgtctacacacacacaaccagagatatatgtatggatacatatatacagataaatgtgcaatatatatacacacacacatatataacacatagattacatttaattgtgtacttcaaatgttttatctccttaaataaaatatttcaaagatcactattttgtcttttctttttggtctgcttaaatttaatgtgagtactggtaggttcacttttttgtttttttgcttttttgtttttttttgagatggagtctcgctctgtcaccaggagttcagtggcactatctcggctcactgcaacctccgtctcccgggttcaagtgattctcctgcctcaacctcctgagtagctgggactataggtgcacaccaccatgcccagataatttttgtatttttagtagagacagggtttcactatgttggccaggagtatggtctcgatatcttgacctcgtgatctgccctcctcagcctcccaaagtgctgggattacgggcgtgagtcactgcacctggtcagttcaaatttttttaaaaagttttatttttactttaagttccagtatacatgtgcagaatgtgcaggtttgttacatacgtatatacgtgccatggtggtttgcagcaccgatcaacctgtcatctagattttaagcccctcatgtattagctatttgtcctgatactctcactccccttccatcccccggtgtgtgttgttcccctccctgagtccatgtattctcattgttcaactccctcttataagtgagaacatgtggtgtttggttttctgttcctgtgttagttgctgcggataatggctttgcatttcatccgtgtccctgcaacagacatgatctcattcctttttatggtgcatagtattccatagtgtacatgtatcatattttctttatccagtctatcactgatgagcatttgggttggttccatatctttgatattgtagatagcgctgcaatagacatacatgtgcatgtgtctttatagtagaatgatttatatgcctttgggtatatacgaagtaatgagattgctaggtcaaatggtgtttctggttctaggtctttgaggaatcaccacactgttttccatgatggttgaactaacttacattcccgtcaaaaatgtaaaaagctttcctatttctccccagcttcaccaggatctgttgttttttgactttttaatcatcgccattctgactggcatgagattgtatctcattgtggttttgatttgcatttctctaatgatcagtgatattgagcttttttcataagtgtgttggctgcataaatgtctttttttaagaagtgtctgtttatatcttttgcccactttttgatggtgttgtttttttttttttttttgtaaatttgtttaactttcttgtagattccggatattagacctttgtcagagggatagattgcaaaaatcttccctcattctgtaggttgcctgttccctctgacgatagtttattttgctgtgcagaagctctttagtttgatttgaccccatttgtcaattttggcttttgttgcaattgcttttggtgtttgtgtcatgaaatttttgcccatgcctatgtcctgaatgatattgcctaggttttctcctagagtttttatggttttgggttttacatttaagtctttaatccatcttgagttaatttttgtataaggtgtaaggcaggggactagtttccgttttctgcgtatggctagccggtttctccagcaccatttatttaatagggaatcctttccccattgcttgtttttgtatggtttgtcaaagatcagatggttgtagatgtgtggtgtttttctgaggcctctgttctgttccactggtctatatgtctgtctttgttccagtactatgctggtttggttactgtaaggtgtaaggaagggatccagtggcagttttctccatatggctagccagtttttccaaaacatttcttaaataaggaatcctttccccagttgcttgtttttgtcaggtttgttaacaatcagagggttgtagatgtgtagtgttatttctgaggcctatgttctgttccattggtctatatatctgtttggtaccagtaccattctgttttggttatgtagccttgtagtacagtttgaagtcaggtagcatgatgcctccagctttgttctttttgcttaggattgccttggttatatgggctcttttttgtttccatatgaaatttaaagtagtttttttctaattctgtgaggaatgtcaatggtagtttgatgggaatagctttgaatatataaaatactttgggcagcatggccatttttacaatattgattctttttatccatgaggatggaatgtttttccatttgtttgtgtcctgtcttaattccttcagcagtggtttctagtcctccctgaagaggtccttcacatcccttgttaggcatatgcctaggtattttattctctttgttgcaattgtgaatgggaatttattcatgatttggctctctgtcaaatcatgtactgtcagtgtatagtaatgcttgtgatttttgcatattgatttttgtatccagaggctttgctgaagttgcttatcagcttaaggaattttggagctgcgacaaaggggttttctaactatagaattatgtcatctgcaaacagagacaatttaacttcttcccttcctatttgaataccctttatttctttctctagttcacatttaaatccagcatcttattctatatatatatatattttaattttctaacctgttttatgtttctttactttcttactttttttgaagtatcttaaatcatttcttgtcttactaattttttggtaaagtgtttttaatgtattcccttagctggtaccacctaacctcataataatattggtaggagtaatagactctgaattgatggtagctggtctaggcacagcatttttcatagtatttcctttggattatggaaaagttaagtattacatatttattttatcaacattgaaacctttgtatttcaaaaggcatcttccaaaaagtaaaaaaaaaaatctatctgtccatagtggaagaaaatatttgaaaatcacatatttgataagggattgtatctataatatataaataattcttatgaatccataagataaatagaaaaagacaaaatattcacaagattaaaatagaaatttatctaaggaagatgtgtgaatgaccagtaagcacatgaaaagagggttaacatcttcagccataaggaaatgcaaatgaaaaccataatgagagaccactttacacacactagaatggctgtaatagaaagacaggtgataacaagtgttgggaagagtgtgaagaaattagagccctcctatccagctggtggtaatgaaaaatgatgcaaatactttgaaaaacagtttagcagttcttcataaacaacaatttcccatatgtctcagcaagtccactcctagcatctcctcaaaagaagtaaaaacatatttttacacggaaaatatgtataacaatgttcataaatgccaaaattggaaagacctaaaatgtccatgacctgataaatgggtaattttggtataaacatatcaaagaatattatatagaaataaaaatgaatgagttctgatacatcctacaacataaataaaactaaaactaattatgctaagtgaaagaagtcatttatgaaacaccataaattgtatgatttcatttatataaaatatgtgaagagaataatctattgagaaacaaagtaagatggtatttttctaggactagaggtttattgggagtgacttcatacattatgagtttaatttgaattcattaaaatgttctttagggctgtggctttgtaactatgtaaacatactaaatatatttagattttaaattttagtgaatgttatgctatgcaaattataattcattatcacatttcttaaaataatgataataaaaataaatttttgagaaagaatagattcatactttcagaaattttaggtattgaattgaaatatcatatttctctagttatgttctttcttttcattgtgcattctatcattaaaaatatttaaaataattatctacatatctttaatttttttgattttataattcattgcagtcattggtgacccattaaatctgtggggttgaaatgtaactttgaaataaactgtctggtggaaagtaaggacagattttacattggttaaatcacttcaatcccttcaaaattagtctcttaaaaacgggttaaaattcatattcactgttgacaaaataatttataaataccacctggtcacaaaactgtaatactcacacagggtcattaatgactgacttcaatgcattgagcaaatctctacttgacatggtcctgatgtccacactgagggctgctcccttggctttcatgtgagcaatgttatcatgttgatccgcaaacaagggaatgcccaccatagggatcccatggtagatcgcctcatagatgccattggttccaccatgagttataaaagctttggttttgggatgacctaaaagtggatgcattttaacaaaattattaattacaaggtatgagaattgaataagaaatgcacaatataaggaacttaaagcaaaactgttccctaggtaacattatacccacaaaactgcattgaaattgttttcaaatttcagaagaattgccaggtgaacaaaatgaaaaagcatattcttaattaaaaaattaaaatgtgcaaaaaaaagaataagattgggtatacaagaacgtggtcttttaagtattataaataatgaggtcacatttacatatttaaaaaatatttaaatacttaaaatatttaaaatatttaattttttttaaaaggcagcagggagtagggtggaggtggggctgaggaaggaccggttatgcatcatcatgaaatgtgttatcattttatcatgataaagattggttatttattcccataaaaagtagagtcactggtaatagaaaagtgtccgctatttttcagtgcctgttgaaataaccctgcagtaggggaaagaacagaggtaaagctgcataaataggagacagacagaaaatccaggatgttatttaaaacctgtgagaggaaattacacctgaacaaagagatttttattctgaccataaagaatgtgactgtatgtaataaaatgccaactactatagtgcattctttttatactaagactggaaaataaatataaagtagttaaatttgatttgttttttagttttccaataataaatgctaaatatgtttgttttatgttgaactattatcactccaatttgctgttactaatatattcactgtttgttctccagaatcttaccaagaaggtcattctggggtaaccacttgtacagtcgagtattggaacctaaagtatttggcttcttgccatcaaatctccatagaacctgttagggcaaggaaaatatcttgttcaatgaatagaactctaaaaacatagcatgttagaattctgaagagattaataatcagttagttaatccatataaaagatgaagaaataagaagaagtgatgtcaagtaatgagaactactaaaagtttgaggtaagttgaatacccacgtttaatgtcgttacttttataatcaattttgtatataaagaaataatgacatttctaacataatagctagacacatgagattgtgaaaggaaaataaatcttggcaacccaaactctatgctaaagggaaaagttaagctgcttagggcaaacctacctcccattctattcaaagtcagcccttgactcactgagataaatgaatatcaaattgcctcatttcgagaggctaatcagaaactcaaaggaattcagctatttgtctctcatctacctatgacctggaagccccttccatgcttcaagttgctctgcctttgtttctagctgtctcccatttctggaccgaacaaatgttcatcttatatatgttgattgatgtctcatgtatccctaaaatgtataaaaccaaactgtccccccaccaccttggacacatgtcatcaggacctcctgaggctgtgtcatgggtgcacattttcaaccttggcaaaataaactttctaaattatctgagaactgtctcatatattcagggttcatattttggtaaccatgaagagattctgagtggaggttccctgacctttgataaatgtcctatcagtgcttggtaccagcatgagctaaatttatggctcaaacaaagaagacaattggctgaggtctgggagcaacccctccagagaatctctgataccccaaaattcagacaagatctgaagtttattttgctgtacaactcctttttgttttttttggagttttacttgcttcctacaagaaaggcaagatttcctgtttccatgacaatggaaggcaggtaactctatggagtttgagctcgctcccaggagggaggatgaatttgaggtttctttcctgattctaggatggcagagggcagttttggcctgaaacccatccgtaggtaaacagctgaattgcggttttgtcttggttaatgtttaacaactagctggacttaatttctccttaccattacagtgcttagtgatcacatttctgggatttttttttttttttgtacattccagtatttctcccatcagatttgatgaactttacctgacttgatcaaatctgagtgagaattccaaattgtgggtaacaaagcctgtctaatttggctaaaattctttgcagacgcaaaagagaaaacaaaacaaaacaaaacaaaacctaaaaaccatgctcttggtttctgtgtttgcttcctgtctttaaaaaaacaaatgttcttttgtttacttttcctccaccctatacctccttttgccttttgccatttgcagtatgaaaaatctagagaaggcttctaatgacttgaactcttttaaagaattcagaacaaaggcaccactcacccctttaggggtgtctgttttctttgtggagttccaagagttgtgggcagatttttttctcagtccaaagctctgttttcctatgttgaatgacctgatctctttggctttgagattaccacagattaccttgtactgtgagaggattttaccttggcatgtgtaatggcagacgagttacaaagtagggggtggctgagtacagtttactggaagtagtattgactgttgctatttttttcctcctaggaagttgttgtttaagaatcctaattctagtttggagatgtgttgtaaagggtctcctctattgtttttattccccaaattaatctcatttggcttgtctgtgtggatttgtgtgagaaactgaactgtggtttacataggaaaatgagagactgagttttctcagctccaaagtgaaagggcatctgctcctcccaggcaaaaggcacccctaagcaactgggggccttgtgggagtgtcttggggttgaccccctgtgacatggagtggccctgcagggaaatccccaataaaaattaacttttaaaaaaaggctagtccaggaaacacatatgagggcagatcacccagcattttgagccctctcagaggtcatacacctctggagagagaaactgagacatgtaagagggtggaaacaactcagtggtgacacactgtggagtactgcccacaagcagcacacattgattcaccacacataaaccctaggccacagctcagttcctccttttaggaaaaaaagtgggaaacaaataatctaagaatgatgagaaaacaagaagaatgaccccctgatatcacttggtaggttttatgacacctctacttggcagagtttatgtaaaatgaaggtaatacggtctttgtgcacatatacattaagaaccctaggttgtcctgcaagctatagagttcctaagttctctctttttaaaaaaaattcttttcttcttgctttaaatttgcttttatttttctattaagataaaaaccacactatggattcaacaggtttttgtctgcaagctggtcaattttttttatctcatggctaaagttctgaagtaaaagccatagaatcttttgtgtgtgtgtacatgtgtttgcatatatttaaaaggccattataatttctataattttatgtttaataggcaattgaatccattttattttccttccagcacaccaaattttttgtctctgtaccttatgatgtaaattttgctatttaattttcacttggtttcttttaatatgcaaatgtaagactatttagcttacaactgcctatggtgatcaagtattcatacagattacctattgaaacaggttatcaagaatttggaagtctaatatggcaaaatgtagttttcataaatctataagatgtacttctattggcatgcttaatgtgtgtatgtatttatgtgttttgtacacagtgttttattactgaaaatatataaaagagctctaattaattggcttaagaaaataaaagtgcttgaattaaatactttgccagaaaaaaaagactagtcaaatgctttttcaagtttatgtaacttcaataaaatcttttataaataagataactttacaattattgctaaagtatgataatattagaaatgtcttaagaatttccagcatatatttttgtttgcatttattaatcaagcaatttcatacttattgttgccaaatactttaaggtgtcaaaatttgacataagggttacaaaactgtaaaccaagcccaaaacagaatgatctttgcttgtgtaattttttaataaataagacattgatattggtttaatgaaaatagccacatcttgaattaagtaagattatcataacttctaaccctgtggccttaagcaatctagtccacaggcagtaaggtttgttttgggaaaaaactgttatcatttttatttcaaagctaaaccataaagggtgtgaaatggcaacactatccttcaactcattttcaactcatataagtttttttcctcaagttctgtttgttgtggcataatgctaacagtgctttctaaaagctattcagctcctcaaggtccagggactatcacagaagaggtgggtgtgtgagattttaagaactgatactgagagataagttagtttatttacaaattaatcattaatgtcaaagacacactaatgcaagaccaacatatgggcccctgtgtcagattaacaaggttttctggaagcataaactgacttcttaataaagattataaaggttatgaaaggctgaggaaagttatatcttatggtcaagattagaattttatagattgttcataaaattttgaaaaacaaagttatttggcttcatgctattttattagggcttattgtttggcaaattgagtctcctctctcaaagaatgaagatttttgcctttttttgaaatccttgagttaccacattagtcaaatgaatgatttatcttacctgtgatattaagtgttttaaacctttgatatttgagaaattttccaaacaaattataaattatgattttttctgacctaagtaatcctttaatttattagtttccctaacatccaaaaatgacataatttggtttattttgtataaaaattatacaggaaacattgtcaaatatgaaatggtgtttggtctttttgagctgtatttatataagtatgttattgttatgtgttccaaaattatgggaaactcctataattctgatatgacttagtgtgtacgttatcagtaacaattatatgtgttaagttattgtgtgccacagaggtaacaaatttccttgtccattgtgtctttgactgagtctgccctaaaactttttgtcctccacagacaattgttgtcttactttggtcctctttagaaggcgattttatactcagccataaaattctaacaggtgctcttgaaaaaaagtttttgataattttggagattgtgacattagaatggaagaaaaactttcaggactcatggagaactaaaatgttcatgagtatcaagcagaacaggaattaactacatggactgaaataataaaaaactaaagtaatcttttagactttgcttaaaacattgctgatcctttgttttgtttttttttcagagtgaaggaatctttttttttttgagctattaacagcttttaacaatttagtatactcctatgaaaaaaatttagaacgtatttgtttccctctacctgatttttcagaatttggaaactatttgtgagtattttttacttttgtcaatacagttatttgcataagtgcaataagaatctattttcatttttaacaaaacacaattggagaaactggttattttatcaaggcttccactggtatggtgggctttcctttagggaatcaaacttaacttatggagccaataaaaccccttgggaaaactggcctcataccttcatctataaggtccctgtacagggttcctgaactgtgttaagcaaagaatgtaactttctgacaggcccaggagccccaagtttattttggaaccccaagaggagaggaattcacccaactcgtaggtatttgatggtagaaatctatggctttcctcagctttaaaaaagtcctatctgagattctttctataagacaaagttccatcaaagccactttaaaagcctatgtaaataaaaaattattcttcctcctctgtatacaataatcaggccaagtataataaagcaaatcagttgtaccatggtttgtctttagtaaaattgggaaactgaagacagaaaaattatgtttcaaaaataacagtatacctgttgttagattctagtcttgcctaatgtttttcaacttttattactgtctacagtttggactgaattctaatttttcatggcgacacgtcttcaaaatagtgtcttcaggttttttttcctccctttccaccatttttcctagtttggagtcactgtaaactaagtcatgctttcatgaagccctacaaattaagctagacaacttaaactccagaagaaaataacagcaaccaatttacatacataatccactttcatacctgcctactgatttatggacttcagagtaatgggcctatattaattttcaaggatttttcttttgtttggttttgtttttctccctttctccctttattttgtcttcataggacatgagacttcacaacctactaaaaatgaactttcctaataactcaggacctgcttaggaataaaccttccttgccattagagatcagatgaaaacctgagaccagagactcattttcttctaaaatgctttctccaaaagattttttttaaatgtaaaaggaaaataagcctgggggccccaaagtcactaagcaaatcactgcctcccattctattcaaagtcacccctctgctcactgggataaatgcatatctgattgcctccttggagaggctaatcagaaagtcaaaggaatgcctcctccctgcttcaagttggcaaaaataaactttctaaatgtactgagacctgtatcagatatttggggttcacaagattatcaatgaaatattcaaatatttaagaattgttaagcagtcttaattctagtaataaaaaagtagcaaattagtaataacctatatatttattttatatactttatactagctgtaaccttccaaatttaatataaatttattaatttttgagtgatatgagaagagtttacttatatccacttgtctactagtcataagttattttatgaatttgacatcattgattacaaaagactaaatatttaaactgcacatatggtgagaaataatgctacatatgtagtatgtgtaatttcttttcatttgctaactatcaagtgctactttcaggaaaaatttcaagtggcagtgtttgacacaaattcagactattatcagtattgctacttttgtaaatgctaacaatgtaggaaaaaggagcccattgacaattcatgattaacaatacagatgctgaaaatgtagaaaattgtattttgctgcattttgcttaactgatctttcacacttagatgatgcactacctagcattgacagccttgatatatggtcagctatagccagtcattaccatgtctagtaccaaactaaggtactgattttagaattcccaagcaatctttataaactggagtagaatttacaagtgttgaccttgtatttgatatgggagtgttaaagtaactctgtgttttcagcaaaaacttgtatagatcattcagagagggctatgtcagataagaaactaaaacgtaaattgaaaatacacaaagattgtatagattagaaaataagttcctaccatgtttatttatattttctgctccttcctcaatctggagaaggcactaatctgattcttagagcatagtctttgttgggccacatttaataatgcacatagtctaccctaaaagcaggattctatctccatcctttccattacatttttctgcttaagacattagcggcacccaagtcagcagagcagacaagttttttttttttttctctaaatctacttggctaggtgggtacctccagagcagtggctagtcagactaggacattctttctctgaatggcaccctgaacagaacactaaatagacctattccaatacatgggaagtaaaaacagccagattgcttggtaagacgaagctgcatgatgcatttcaaagttttttcgatacctgcttattgttattgtgatagtacagtaacttattaaaatttaactgctttttgataatatctacagtgtatacagtaccttctaaaatcctgtaaaccaaaaggagcaaatgacagggcagaatttagtgatttctatgtacatgctacgataccatgataataccaaacttcactagcacctcttaaatatatttccttctgatcacaatattaatgccaacgttattatcaaccaaaactcctctctttatgattttaagatcttccatatatgtttttgttttgaacagatgtctgagataattagaactatcatagcagttaaattttcaggcagaacatttctgtaatggactcttgaagagtttaacagattcatttagtagccatccacagttaaggcactttatctaaccttttgtgggatctgggcaagggctgatgcaatcatgttggcactttcttctgacatgttactgatcatcgaccccagagaaaacaccacaataccattttctccagagctctgcacaaactcttccatttcctgtgaagaaagaatttgttctatcagaaaagagcaacagcacagaaaacactattgacaggattgttacaaacatctaagatgagaaagtcagaagctattggagtaatttttttaaactgacctaatcattcagtttctttgaaaggagatgtgtaatataatatatgtgggatctttcatgcaaatttgtgtaaatatgtgtgcatatgcatgtatgtatgtgtgtgtaaggaggaaatgaaacaaagctatgacactgcagtaggaggagataatgctagaaaatgttacacccagacactttatttataatattataattactaacataggttattggaaggtagctttacttggcttcaattctaattttttttgtggttctactaaatctcttgtgtttatttggggtagttttattttattttatttttttctgttcagttcttttagttaggagtcattggagccattacatgactatgagcattgaggaaaagttagttacaattggaatgatattatatctacatttatttagcttctagctctctaaccctttatatttcacttaaagttagggtttcctagtcttaccccactacccctcactgcccccgacacccccaccccccaaaaacaccttaaaagctgaagtataagaatcactgacattcagcagtctggtattgtggtttggaatttctgggaaatagttctgagaattccatttataatacagtattatatactatatagttacataattaagtgatcttatttctcaggtcattgcttaggtatgactatgacaccttttgtcctgaaatcacactgtgaatttgatgtgctatgtataactgaatgtgggggaccctcatcatcactttgctgtgtctcacagggggcacttgaaccacagtgggagaggtcaccaggactttctccagtggagatctgctcaccccctagagtagctccctcacactatatgaagctcctggtgaatatgtgtttgctttgaaatgaatgagaattattctgacttgtgtttcctgatgtgtccctgtttttaaacttaaatccattctctaatgccacatcgctcaatgtattctcacaccaaaaaaaaaaaaagagagagagaaagaggaaaagaaatgtagacccataagtttcctggatatcatatcaaaattgtatactcatctttttgttgctgttgtcccttttgttcaaaattctctttttctcagtaaaataatgaccaaccccttctgtcataacaaatatactttctggtcctaatcattgggggaaatttctttataaaactgtttacaaataaaaaaagaaattctaaaatatgtcaattcagaccatatattggtaagtatttttaaaaaatataatttaactttatgacatcttttttttttttccagatggagtctttctctgtcacccaggctggagtgcaatgatgcaatcttggctcattgcaacctctgcctcccaggttaaagcaattctcctgcctcagtctcctgagtagctgggattacaggcacctgccaccacgcctggctaatttttctgtttttagtagagacaggtttcaccatcttggccagactggtcttgacctcctgaccttgtgatccacccgcctcagcctcccgatgtgctgggattacaggcatgagccactgtgcctggcctgacatcagttttaattggagattcagtgtatggctattagagataattcatgaggcatccaggaactcagtgtaattgcagttgcctgtagccacatttaatgtaacttgagttcaatgttttgtctcattcactgccaaaagtctgcttcacccacccagtattgaagtaataaaacatctatttatagacagatcagcactgatctcattctgtgatgtctttatgaaagtaatggtaatagaagatcaatgtaagtagttttataaaagtatgaaaatttagaaaaagaaaatcatttacccatatctctatctcaatttaaaatgtgtgccatttcattatgggtttaattctatttatataactcaatgtacatatgtgatgtttatttagaaaattttattctcattgtatatgcctttttattctacaaaaaaactgtgatcttgttctactcatcattttgttccttagtttccaactatacctgtaccacggctgacagtgtaattaaacattgttttgaaaaaaggattgtaatggcttggtatgcacattatgtaagtttttaaccatttcttaatgtaagatatttgaattatttccagagtttttttaatgagtatttgctaccgatattgaatcttaccatcatgatttattctctgtacagtttcatgtgagtatattataaaggcaatgcctatatgcatttttcaaacacttgatactttttggcaagagtcttattcttttgaaatatacaaacattatctgagaatctaatacataatggaaaagcaagcaaatttgtcgcaacaattattttgtgtacaaaagaattagagaatcagtttcacaattatttacttggattcaagtctaccttctgcaagttaacaacaacggaggctcacacttgtaatcccagcactttgggaggctgaggcatgtggatcacctgaggtcaggagttcaagaccagcctggccaacatggtgaaactctgtctctactaaaaacacaaagattagtcagatgtgttggcaggtgcctgtaatcccagctactcgggaggctgaggcaggagaatcagatcgcttgaacctggggggtggaggtttcagtgagccgagatcatgctagtatcagtaataatcactattgtactactagtcatttatcccttgtccttattctgctactctcttccccctgctactggcactatcactttcttttaatgtgagtgaggaatttttttttgagaataagataagagtacacagaattaccttttaagctagaatattaatgaagagcctccacctttacaatacaactttagctttccagcttgttcaactgactgcccaaacttaaacatttacatttaaacaagtacacagagtatctgttctctaggactttgctagagaatataatcttgatgtgttggaaaatcaatcactattaaatgaagactgatatcttaaatggctggcacatgttagctaatttaaagtattaaaaataatgactgaaataatcataatatcaacaatatttttggatcactggctgtgtgtcagagacaacttaagtgttttatctgtggtaactactttttttccacacagcacaatatgaagttgtgattattattataaaagtagtcatgattgcttaaactcatgtaaaagttcctaaatgatctttacattttacaaacttgcctttttgcaatattatacattgggaatattgggattttttaaaaggaaatctgatcatatctcttcatttcttaactcttttcactcttttcagtagctctccattgtccctatgggtatatcaaattacatatatatatatatatatattttttttttttgagacagattctcactctgttgcccaggctggagtgcaatagcgtgatctcggctctctgcaacctctgcctccggggttcaagtgattctcctgcctcagcttcccaagtagctgctattacagtcacctgccaacatgcctggctaacttttgtatttttagtagagacggggtttcaccatgctggccactctggtctccaactcctgacctcaggtgatccacctgccttggcctcccaaagtgctgggattacaggtgtaagccaccacgcccggcccatcattgacttttactcaaccttttcctgtaaattaaatttggagttcctgggaactgcccttattgcttttctacttttctgccttaatgcaagcctttactttttttttttttgtttatttgtttgtttttgagacagagtctcgctctgtcgcacaggctagagttcagtggtgtggtctcagctcactgcagcctctgctcccagactcaagcaagcctcctgcctcagcctcttaagtagctacgactatgagactacaggcacacaccagcatgcctggctattattttattttttatttttgttagagatgaggttttaccacgtttcccaggctggtctcaaactcctgagcccaagcaatcatgccttctctgcctcccaaagtgcagggattataggtgtgagccaccttgcctggcctctggttttctttttgggtgtttatcaacccctcatcgtttcacctatctctgcacattattgagtactcactttaattgtcaatgagtttgggatctcttctgcatatttctttatcattgtggtctttccttataacactttttagacttttctttttcacttgtttttattctatctttcaaagtacaatgtaaggcatgagggagcagaaactgtgctacctttattctctgaaaatccagcacttacctgtggtttgtattaatcactctacaaatattttttgaagaaatgaatcatactatcttttgggtggcacaatgaaggccttactttaaccaaccctgttttcaaaatctccctagtaaacctctttggtctttaatgataataacattcacatacttgtgatactacagaaatatatgattttctaatggcaagtccttgtttttgacctcccatattcccctcactctgagttaaacactctgaaagaaacatatccagccattccttctgaaaatgtcaagcaaacaaatgaaacaagaatacatttaccttaggcaggggtttggctggtttacagtgaagtcctccaacaaaatcaacatttggtaagaatgggcgaggaaattcaaaatcccaataggttcgaatgagccacatttcagctttccccattgtctcaaataatgtagtgggtcttcctgatggaaaaaaacaaaacaaaacaaaaggtagctaacacgagaattgttatttgaatatgcaggtattttcctgaaaggacttggaataacatacccaaacatatataaaatgtctgtgcattgataaaatatatataaatacatttatatatagtcataatttagattttatttattgcatatgttgctcatatgtatatataaggaaggcaatgtattcagagatctgtaagaagaaatcacatctttaatgtaacatcagtatattcacaatcataaataattattaaaataagtcactaatatggtttgactgtccccacccaaatctcctctcatcttgaattataatccccataatccccatgtgtccagggagggacccagtggcaggtgattggatcatggtgtggattcctccatgctgttctcatgatattgagtgagctctcatgagatctgatagttttataagtgtctagtatttcccctgcttgcacttctctctcctgccactaagtgagaagatccaagcttgcttccccttagcctttcaccatgattctaagtttcttgaggcatcccagtcatgtagaactgagtctattaaacttcttttctttataaattacccagtctcaggtatttctttacagcagtgtgagaatggactaatgtagccactatgaacttaaatacacatttgtcttccctctgaagctgcaatagtaacaaatatacctttaaacaactctttcagttccacaattaattcatcttaccttacccatgaaaacagctttccaggaagtactctagtgtctacagtttattaagctagtcccttgatccttggttctcaaagtaaaccatgagttttttgagctcaacactgaaatctttacacctactactgtcttggttcatcttaagatcttaatataattagatttttaaaataaatatatttacaaatgagaattaaaacattttcagaatttattgacatagagatatgtgctctcccttaatttggcccctattttctttgatggagagatgcagtttaataaaatatagattaaaacttagatgttcactttcaacaagatttcagtttttgaaagaaataattgtcaacctgttattgaaggaatgtataaacattagaaatctcaagttttaggcttctgtttctggagtagagccactatattactcaactgtgaaggaatccttcttacatgaaaaacaaaatttaatttctaaatgaggaaactgaggaactcaaagagaaacaaattcctcaatcctgcattgataatttttctagaaatatgtgtaaatactaaatttatgtgtctgccttcatgaagatgtttcttgaggtatctattgactttttttaaagatgaaaaaatgtatagcaaaatgatatgtgatagtttaaagaaatcattagtgctttacaatgaaggtttatgactctctgggtgtcctgtagtagtgatggccccagggttctaactgattctataaggtcaacattctataatatttttgagactgatagatcatcttacatttgcaattcataatttcccttaaaaacactatcttctgacattatatttatataagctcaccttcaaaggcacagaaaagttagaacttaataagcaccagttagacacatgacttacctagaacttcactataaaactggtcccacttcttcagatcataaatttgaaaccaaaagtcaaaataaagcatatgtatcatattttttatcctctccatgaaaatcatttgatcacttaattctgacataacaacaggtacataggaaggagggaacagaaatcctccaccattcttctcaaatgtgtagccaacagagaatcgaagactgtacagaaagggtatgttaaatagttcagccagtagctcaccacagggattaagggcatctgccagaatgacatcaaactttgactcttgtagtttcatcataagtttcttattcaaaactgcatctttacagagcttgttactgtagtcataatattcccaacacaattcttgtaattgtgaaaaatatgaccaaaatgtattttttgaaacaccatatatccatctatcgagaattttcagaagagaatcttccaaataatttttagttaaagatgtaggataaacttctaatttaatagcagatgatttactggcattgacaagagtagaagccgaagatgtcaacacagtcacctcatgacccctctgaacaagctcttccaggattgtcttcatatttatccaatggctgtattctgtgggccacactagcacctttccacagcttccagagctaaagtaacaactgagctgtatcagcagaaagactgacgtccatttcagagacatcctggtcttatgcaatgcttcttttccagttgttgtttctttctgtcatttctcatacttatatctgaggaaaaatcaatcaagttaaaatataactgctaaaatttgaagtaaatacataatactaacagtctgaataggtgcatgccaaggagaccaacaaaagattgatgacctcatatttattttagtgtgtttggtgttcttttatgtttacaattactctagtcaagcaataatttttatgacctagaatatgtaagtaacctgtcttatgtaattattttataatactgttaagaacagtggcaagtgagaggctcctgcctgttcggtgcccttgacatagagagaagaagtaattatacaactcaaacggcattttttaatatcgtggtgcaagtaatgtcttctaaaactttgttgacacataattcatataccatatgactcaccaattagtgtgtacagttcaatgtttcctagtatattcacagaattttacatccactacaataatcagtattatctccaaaagattctatacaatagcctctaaccccccactctgaaattttgcatccatcctaccctaggcaaccactaatctaatttctatctctatagattagcattttctggaccctttaaaaaataaatgagggttttccagtgatcatggcagatgggatgcaggactagattgcagctccagacagagcagcatgcagaggcttgcattgtgaattttagctgcagatcaactgcaagaacagaccagcaattctgagaggatccacacaccctctgcaggaagagtactgctcctgcaggacctgggagacatcccaaacactgtgagtgccccaacaatggaagtgggaaagggtgatccccctctccagaatacacatccccactggagaagctgaagttctgtttgcaggagaagttcctgactttatgtgaagctgagtcaaattagagaaccaagccaagcaaaatacaggggtagaggaagtagcagaaaggcactgggagctctctggatacccaagcggctcattcctgcctggcatcacagggatctatcaggagggtggccagtgatgcagggggttcaaagattctcctcaggacctgaaggcttgaagggatgagtaactcctcccttctcaggcccagccccaagatgcaagaccacttgcatcagcagcgtgtgtcagcaagatagcagaagcaggaagagagccggccagaagacacttaccctggctggaagagatgtacccctgaagatcaagaaataggccatccaggtactacatagcagtcacaacagactgggacacttactgtttacagaggactacaaaacccctgtcccatcctcacttggggctgatgccattttaggcctcagcccacctgcaaccaggcgttcattaaaacagcatgttgctccacaccgcctcctgttgtctgttggcgcgctgttggggttcaaactgattcaagaaccttacatctggtgccaaatcctaggaggggctcaggtctgtgtcgcttgtggacctatccctccaccccagagagcaggccacagcaattagacagaggaagctcctcagcctccagtcgcctctctgtgcatgcgcatcagccactgatctcgcctactggtaagtttcccttggagcccggttaacagggcaaaatctacatggcctctcttggtttctccagtccaaaaatccaacactgatccaagaaggcgccagcgtgcgccaggcactcgctggtcatctggtcttagggggatgcctctaagccatttcatcccgttccaggaaccaaaaaggcagcggagacgataactccttttatcgtctccctccagctgtccaggatggtctcctttttccctgttctctcgagctacccttcattatgggaaactcccggtcctcaattccaaaaaacagccctccagcctgcctcattaaaaatctgcaaaccttaggcctcaggcaagatatctgccataagtgccttgtcttttttatacgataaagcctggtcgcagtatgaattagataacgggtccaaatggcccgcaaatggaacactcagctttacagttttaactgacttaagcagttattgcagatgactgggaaaatggggagaaattccttgtgtccaggcctttttgcactcagatcacagcccgacctctgcaattcttgcttacctgttcaaatccttcttcattctcgccgccctcattgcctttatcctcccgaccctacctctttttcctcattggatggagcagactgctgtccacccctcccagaccctacccctccatctcaaccaacttcattaactccccaagcttcctcattgtcttctcagccaccatcttcccagccaccatcttcccagccagcatcacccacttcttttcctataccatcctctcctcaggaaaactctagcattgcctgtactcattctccttccttacagccctctcacggagcctgtaaacccatcccgccaccttacacccgtatctatcctccaatgcctatcaactcaaccccccttccctcttcaaaccctcagcaggaaccccttctggcttcttccttctctcctgcccatactagctccggcaccatctttggcccatgccccacccgtactttagcgccagtgctagaatgcccccttcgggaagtagcaggaactgaaggtattgttagagttcatgttcccttctccctcactgatctctctcaaactaacaaaagactcagttcatttccagaagatcctacctcttatattagggagattcagtaccttactcagtcttatgaactaacctggcatgacagctacttatcttctcttccaccctcaccccagaagaccagcaccgtacttggaccctagctcaggtgcatgctaatacaattcatcatcaagctcctgcccagcctactggcacagaggcagttcccaaccaggacccccactgggattatcaagacagggcctctggacacagccatcaagacctcatgattatgtgtctccttgcaggactcaaaaagggtgcccataaagtggtaaactatgaaaaactttcagaaatcaccgaaggtcctgacaaaaacccagccctttttctctcttgtttaactgaagccatgagaaaattaccaacctggacccagccagcccagaaggaaccactatttcaaaccttcagttcctcacccaatctaccatgatatttggcgcaagcttcagaaggttgatgacggccctcaaaccccacagtgggaccttcttaatttagccttcaaagtctttaacagttgtgatgaggaaagtaaaagaaaaaaacagtttccaatgcttgcctttaccctgcaggcccacagggccacagctccatacagaagcctcctagcaaaacacctccacctggcgcctgtttcaagtgtggcaatgaaggctactggtccaggccatgcccaaacccagctgtgctcaccaggctgtgccccctctgtggaggactcagtgaaagtcaggctgtgagcggctccagcaaggatcgcctccatccctttccgagctggccaaaacctcctactcggatctcaatggccttgccactaaagactgacagtgccctggaacagatgtcccagcaactaccattgcttcatctgagccaagggtaaccctgatggtggcaggtaggcatgcatgttttttaaaaattaatattggagcaacctactctgctttacctaaattttcaggacccacccagtcctcccaagtctctgttgtgggaatcaatggacaagtctccaaaccccaagacccccctccacttttctgctccctgaacaccttttccttcagtcactctttcttagtcctgccttcatgcccagctccgctcctaggcagagatattctttcaaaactccacactactctccacttccacattccccatagtacccaacacatcaacccagacccctccaaggcttctaacaggcttctaaccttcttctactcctccgacctcccaccctgaaacatgcaacttttccttatcccccacctgtagttaaccccactgtttgggatacttccacaccctcggtcacagagcaccacacccccatccacatcacccttaaagagcccaccccgttcctatcacagaagcagtatctcatcccccaagcagctctcataggcctaaagcctatcatttctctcctcctcaccagtcacctactctgcccaacaaactctccttttaacacatcagttctacctgttaaaaagccagatggaacttatcacttagtccaggacctcaggctcattaaccaagctgtactcccagtgtgtccagtagtttctaacccatatactttactttcctcacttccctcgaataccacccacttttctgttctaaacctaaatgatgctttttcacaattcctttacaccctgattcccaaaacctctttgcctttacctgggaaaaccccgacacccacctttcaggtcagctcacctggtgcgtactacctcaaggttttagagacagcccccacctttttggacaggcccttgctagtaacttctgtactttatccctaaaatcatcctctcttctttaatatgttaataatctgctcctgtgtagcccctctcaaagagactgcaacacccatacatactatctcccttttaaacctcttggcagaacaggggtatcaggtctcccctaagaaagcccaaatatgcaccccccagtcacctatctaggcctagctcttacccctgaatgcaagggctcacaacagaccacatactccctccttcagtccctcccgcctccacaaactaagcaagaaattctctcttttccaggattagcaggatattttaagctctgggtttcctccttcgctctacttaccaaaccgttgtaccaagctgctaaaggccctctccatgagcctttaaaacctgcacagcctattacccaacctttccatctactccaaaagtctctcatctcagcccccatcctcactctcccagacttcaccaaacctttctccctctataccgatgaatggcgtggagttgcactaggtgttctaacccagtctaagggacccacccggccaggttgttgcctacctccctaaacagcttgaagccacagttctcggatggcctgcctgcccctgagcattggtggcagttgctgtcctcactcttaaaagcctaaaactatctcttcatgccaacctaacagtttattcaacccataacatcaaagacatgttagctcaccgcagtgtactaagtcttttctctgccccacggctcctccagctgtatgctctattcatagaaactccccacatcaccatgctaaccacctcccatctaaacccggccatgctcttacccgaagctacaaccgcccaagactcttcttcacactcttatgtgtgaatactgttcaaacctttcttataccttttccaaacctaacagaaaaatcccttccagatgcgtcctttactcggtttgtagatggcagctccttcctacatcaaggacaccgacatgctggctatgctatagtgtcaccccccaacactattgaagtcaatctgctcctcttaggcaccacctcccaaaaggctgaactcattgccctcactcgagctctcattctagcatccggaaaacagatcaatatattcaaattctccttatgtgttccacgtagtgcactcacactcatccatctggaaagaacggggtttcctcactgcaaacaatactgtcataagtggctctctcatcagcaagctccttcaagctgccaggctcccacagaaagttgccatcattcattgcaggggccaccaaaccccagacaatcctaaattggctggaaatgtgctagcagatcaggtagccaaacaagtagccctactaccctttcgaggccagttgctgtccttgtccttgttctctcctctttacttctaagaagaaaaagatttccaagcccaaaaccttcaaaagcaaggacgatattatgtcaaggaagggtgcttagttattcctcactctcaaagccttcctcacctccaaagcctccacaactctttccatgttggttaacaacctcttgcagcttctccacgctattctcacttgtcgtcacttttccagccatgttcaagaaattatccagtcctgctctatctgccactcaatgtaaccccagggatccctccagcctctgccttttcatacccaccaagcccagggccagttacctggggaagattggcaagtagacttcactcatatgctgcatgataaatgtctctgctatcttctaatccttgtctgtactttctctggctagggagaagtgttcccaacaacttcaaaaggtgcaaatatcatcacacaaactcatcatgcatacagttccctgtttcagactcccaacatccatccagtccgataacagtcctgccttcatcagccacattacccgaggcatctctacatccttaagaataagtaagttctccacacaccctacacacctcaatcttcaggcaaagttgaaaaaattaactctgtccttaaagcctaactcatcaagccggctctagaaacctgcgagtcatggacaaaaaaatctcccttttgccctcatgagactttgcacaacaccaaaagcaccctctttttttgtttttgtttttgtttttgttttgttttgttttgtttttattatactttaagttttagggtacatgtgcacaacgtgcaggttagttacatatgcatacatgtgccatgttggtgtgctgcacccattaactcgtcatttaacattaggtatatctcctaatgctattcctcccccctccccccaccccataacagtccccagtgtgtgatgttccccttcctgtgtccatgtgttctcattgttcaattcccacctatgagtgagaacatgtggtgtttggttttttgtccttgcaatactttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgcagcaataaacatacatgtgcatgtgtctttatagcagcatgatttatagtcctttgggtatatacccagtaatgggatggctgggtcaagtggtatttctagttctagatccctgaggaatcgccacactgacttccacaatggttgaactagtttacagtcccaccaacagtgtaaaagtgttcctatttctccacatcctccctggcacctgttgtttcctgacttttaatgattgccattctaactggtgtgagatggtatctcattgtggttttgatttgcaattctctgatggccagtgatgatgagcattttttcatgtgtctgttggctgcataaatgtcttcttttgagaagtgtctgttcatatcctttgcccagtttttgatgcggttgtttgtttttttcttgtaaatttgtttgagttcattgtagattctggatattagccctttgtcagatgagtagattgcaaaaatgttctcccattctgtaggttgcctgttcactctgatggtagtttctgttgctgttcagaagctctttagtttaataagatcccatttgccaattttggcttttgttgccgttgcttttggtgttttagacgtgaagtccttgcccatgcctaatgtcctcaaagtattgcctaggttttcttctagggtttctatggttttaggtcaaacatgtaagtctttaatccatcttgaattaatttttgtataaggtgtaaggaagggatccattttcagctttctacatatggctagccagttttcccagcaccatttattaattagggaatcgtttccccatttgtggtttttgttaagtatgtcaaagttcagatggttgtagatatgtggcattatttctgagggctctgttctgttcccttggtctatatctctgttttggtaccagtaccatgctgttttggttactgtagccttgtagtatagtttgaagtcaagtagtgtgatgcctccagctttgttcttttggcttaggattgacttggcaatgtgggctcttttttggttctatatgaactttaaagtagttttttccaattctgtgaagaaagtcattggtagcttgatggggatggcattgaatctataaattaccttgggcagtatggccattttcatgatattgattcttccttcccatgtgcatggaatgttcttctatttgtttgtatcctcttttatttcattgagcagtggtttgttgttctccttgaaaaggtccttcacatcccttgtaatttggattcctaggtattttattctctttgaagcaattgtgaatgggagttcattcatgatttggctctctttttgtctgttattggtgtataagaatgcttgtgatttttacacattgattttgtatcctcagactttggtgaagttgcctatcagcttaaggagattttgggctgagatgatggggttttctagatatacaattatgtcatctgcaaacagggacaatttgacttcctcttttcctaattgaataccctttatttccttctcctgcctgattgccccggccagaacttccaacactatgttgaataggagtggtgagagagggcatccctttcttgtgccaattttcaaagggaattcttccagtttttgcccattcagtatgatattggctctgggttgctcatagatagctcttagtattttgagatacatcccatcaatacctaattcattgagagtttttagcaagaagcgtcgttgaattttgtcaaaggccttttctgcatctattgagataatcatgtggtttttgtcattggttctgtttacatgctggattaagtttattgatttgcatatgtagaaccagctttgcatcccagggatgaagcccacttgatcatggtggataagctttttgatgtgctgctggattcagtttgccagtattttactgaggatttttccattgatgttcatcagggatattggtctaaattctctttttttttgctgtatctctgcgaggcttcagtattgggatgatgctggcctcataaaatgagctagggaggatttcctctttttctattgattggaatagtttcagaaagaacggtaccagctcctccttgtgcctctggtagaattcggctgtgaatccatctggtcctggactttttttggttggtaagctattaattattgcctcaatttcagagcctgttatcagtctattcagagattcaacttcttcctggtttagtcttgtgagggtgtatgtgttgaggaatttatccatttcttccagattttctagtttatttgcatagaggtgtttacagtattatgtgatggtagtttgtatttctctgggattggtggtgatatccccttaatcattttttattgcatctatttgattcttctctcttttcttctttattagtcttgctaacgatgtattaattttgttgatcctttcaaaaaaccagttcctggatttattgattttttgaaaggtttttgtgtctctatttccttcagttctactctgatcttagttatttcttgctgtctgctagcttttgaatgtgtttgctcttgcttctctagctcttttaattgtaatgttagggtgtcaattttagatctttcctgcttcctcttgtggggatgtagtgctataaatttccctcgacacactgctttgaatgtgtcccagagattctggtatgttgtgtctttgttctcgttggtttcaaagaacatctttatttctgccttcatttcgttatgtacccagtagtcattcaggagcaggttgttcagtttacatgtagttgagtggttttgagtgagtttcttaatcctgagttctagtttgattgcactgtggtctgagagacagtttgttataatttctgttcttttacatttgctgaggagagctttacttccaactatgtagtcaattttggaatagatgtggtgtggcgctgaaaagaatgtatattctgttgatttggggtggagagttctgtaaatgtctatcaggtcaccttggtgcagagctgagttcagttcctggatatccttgttaactttctgccttgttgatctgtctaatgtttacagtcaggtgttaaagtctcctattattattgtgtgggagtctaagtctctttgtaggtctctaaggacttgctttatgaatctgggtgcccttgtattgggtgcatatatatttaggatagttagctcttcttgttgaattgatccctttaccattatgtaatggccttctttgtctcttttgatctttgttgttttaaagtctgttttatcagacactaggattccaacccctgcctttttttgttttccatttgctcggtagatcttcctccatccctttattttgagcctatgtgtgtctctgcacgtcagatgggtttcctgaaaacagcacactgatgggtcttgactctttatccaatttgccagtctgtggagtatttaacccatttacatttatttttaaatgtattggagtatttagcccatttacatttaaagttaatattgttatgtgtgaatttgatcctgtcattatgatgttagctggttattttgctcattagttgatgcagtttcttcctagccatgacggtctttacaatttggcatcttttgcagtggctgctactagttgttcctttccatgtttagtgcttccttcaggagctcttttagggcaggcctggtggtgacaaaatctctcagtatttgcttgtctgtaaaggattttatttctccttcacttatgaagcttagtttggcgggatatgaaattctggattgaaaattcttttctttaagaatgttgaatactggcccccactctcttctggcttgtagagtttctgtggagagatctgctgttagtctgatgggcttccctttgtgggtaacccgacctttctctctggctgcccttaacattttttccttcatttcaacattggtgaatctgacaattatgtgtcttggagttgctcttctcgatgagtatctttgtgttgttctctgtatttcccgaatttgaatattggcctgcattgctagattggggaagttctcctggataatatcctgcagagtgttttccaagttacttccattctccccgtcactttcaggttcaccaatcagatgtagatttggtcttttcacagagtcccatatttcttggaggctttgttcatttctttttattattttttctctaaacttctcttctcatttcatttcattcatttgatcttccatcactgataccctttcttccagttgattgaattggctactgatgcttgtgtattcatcaagtagtctcatcctgtggttttcagctccatcaagtcctttaaggacttctctgcactggttgctctagttagccatttgtctaattttttttcaaggtttttaacttctttgccatgggtttgaatttcctcctttagcttggagtagtttgatcatctgaagccttcttctctcaactcatcaaagtcattctccatccagctttgttccatttctggtgaggagctgcattcctttggaggaggagaggtgctctgatttttagaatttccagtttttctactctttttttttccctatctttgtggttttatctacctttggtctttgatgatggtgatgtacagatggggttttggtgtggatgtcctttctgtttgttggttttccttctaacagttaggaccctcagctgcaggtatgttggagtttgctggaggtccgctccagaccctgtttgccttggtatcagcagtggatgctgcagaacagcggatattggtgaacagcaaatgttgctgtctgattgttcctctggaagttttgtctcagaggagtacccggccatgtgaggtgtcagtctgcccctacaggggagtgcctcccatttaggctactcagttgtcagagacccactggaggaggcagtctgtcctttctcagatctgcagctgcatgctgggagaaccaatactctcttcaaggccatcagacagggacacttaagtctgcagaggtttctgcttccttttatttggctatgctttgttcccagaggtggagtctacagaagcaagcaggcatccttgagttgcagttggctccacccagttcgagcttcccagctgctttgtttacctactcaagcctcagcaatgtcaggcacccctcccccagcctcgctgccaccttgcagtttgatctcagactgctgtgctaggtatgagtggggctctgtgggcataggaccctctgagccaggcatgggatgtaatctcctggtgtgccgttcactaagactgttggaaaagcgcagtattatattaagagtgacctgattttccaggtgccatctgtcaccgctttctttgattagaaaagggaattccctgaccccttgcacttcctgggtgaggcaatgcctcaccctgctttggctcatgctcggtgcactgtacccactgtcctgcacccactgtctgacactccccagtgagatgaacctggtacctcagttggaaatgcagaaatcacccatcttctgcatcactcatgctgagagctgtagactggagctgttcctattcggcctagctaattattaatatttcttttcttatagtaattttggttttggtttgttcttgcttttctagtcatttgagatagatcattacattttttatatgaaacctttctccttttcttgtgtaggcatttcttgttctaaacttgtctcttaatagtgcttctgttgaatctcacagattttgctattgcatgatgtgatctttctttgttttaagcaatttcaaaattgtttcttttttatctattggttataaggaatatgttgttaaattttcatggatttttctagttttgtcttggcattgattttataatttatttcattgtgttcagataaaataattagtaaaatttttattttttaaaatttgttgagacttgcttaatgtcctcatatatggttaattctggggatgttatatgtgctataaaaagaatcttacattctgcagctgttggttaaaatgttctgtaaatatcaactacttcaatttggtctatggtacagtttaaatctcatgttgctttattgtctaaatatctgtccaatgctgaaaaggtgatggtgacatcctcaactattattggacttaggtctatctctcctttcaggtataataatatttgcttcatatatctcagcggttcatggttggttgcatatatatttacatttttgtctttttgaacaattgattcatttattatcatattaagtctctcttttcctctcaaaattttggcttaaagtttgtgttttgctgaggtaagtgtagctatttctgcttgatttgggtttctgtttgcatagcatatctatttcatcttttcaattgcagtctatgtgtaactttattggtgagatgagtatcttttaggctgaatattgttgagtcttgttttttaatccatcaatctacgttttcagttgtgtaatttaatccacttattttcaaggtatttatttatttataggtaaaggcttattcttttatttttttctgtttattttgtatctcccttattccttaatttctctattacttattttgacagtttgatagttttctatactgataaagtttgattattttttctttcacctttgtctgttggctgtatgagtgagttatataattttgtgtgtttttatgaagtgtattatcatcttttcaccttcagatgttagacttcctcaaatattccttttaaggctggtttaatggtaataaattctttatgtttttgcttgtttgagaaatactttattcctctgtctctgttttttttgtaggatcaaagtttgctttatataatattcttcattgacatgattataaaacaaattttatcacttagcatatattttcctattctttcctggcctataagttaatgctgagaaatccactattagctgaatggagattcccttatagatgatgtgtcagctttcttctgccatttttagaacacctgctttgcatttgacttgataatttgacgatatgtgcatcagtgaagacctttttggattgaagtaacttggtggaactttcagcttcttggatctagatgttcatcttttgtcaataacttaagaagctttctgctattatttcattgaatataatttctatgctgtttatcttctcattctagaattttcatcatgttaattttttttcttttttacttagtgatgttgcataaattctgtaggattactttattctttttcttctttcttgtctatgtgagtcatttcaaaaacatggtaatagttggaaattatttcctctgctttgtctcttatgttcttgaagctctcaatagtatatttttaaaaaaatttgttcattgctttaaagtattttatatttttgtgggtacatagttggtggatatgcttacggggtacatgagatattttgatccaagcatgttctagtgaaaaatttttacaatgaacaattcaataaagttgcagaacatgaaattaacagacaaaatcaataacatttctatttgcctacaatgagcagctgaaaaagaaatcaaaaaagtattcccatttacaatagtcacaaataaaattgaacatctaggaattaaaggactgaaagatctctataatgaaaactactgatgtaagaaattaacactgatgtaagaaaacactgatgtaagaaattagagggtaccaagaaatgaaaaaatattccatgttcattgattagatgaataaatattgttaacatttctatattaagcaaaacaatctactgatgcaataaaatcatgaaaataccaattacattcttcacagaaatagaaaaaaatctcaaaatgtatatgaaaccggaaaagacccagaatagtcaaaggtatcctaagcaaaagaaaccaacttggagtcacattatctgacttcatattacactacgcacctatagtaaccaaaccagcatgttactgccataaaaacagacacagagatcaatgaaacagaatagagaacccagaaaacaatctacacacctgcagtgaactcattttcatcaaagttgccattaacatacacagaaaaaaagacagtctctttaataaatggtgctgggaaaacagaatatctatatgcagaagaatgaaactagatccctagctctatccatatacaaaaatcaaataaaaatggtttaaaggcttatatctcagacctcaaattatgaactactacaagaaaacattaaagaaaatctccaggatgtttttctgggccaaaatttcttgggttataccccataatcacaggcaaagtaaaaatgaacaaatgagatcacatcaagttaatcagcttctattcagcaaaggaaacaatcaacaagtgaagagacagtccacagaatgggaaaaatatttacaaactatccatctgacaaggaattaataaccagaatatataaggggctcaaaccctctataggaaaagataaaaaaatggacaaagaatttgaatagagatgtttctcaaaagtaaacagaaaagtggcaaacagacatgtgaaaagatgctcaatatcactgatcatcagagaaagtcaaatcacaactaaaatgagacatcttctcacaccatttaaagtagcttatacccaaaagacagacaaaaataaatgctgatggggatgtgaagaaaaaggaaccctatacaattttggtgggagtgaaaattagtaaagaccactatggagaacagttgacggttcctcaaaaaaatgaaaaatagagctaccatatgatccagcaatctcattgctagatatatacccaaaagaaataaatcagtatgtcaaagagatacccgcactcccatgtttgttgcactatttacaatagctaagatttagaattagcgtgaatgtccatcaacaaatgaatgaagaacatgtgttgcatagacacaatggagtaccattcagccatgaaaaagaatgagatccattcattttcaacaacatggatggaactggagctcattgtgctaagtgaaataagccaggcacagaaagacaaacatggtatgttatcacttatttgtgggatctaaaacttaattaaactaatgaacatagaaagtagaaggctgattacttgagcctgggaagggtactgggggcatgggggtaagcagggattttaacaggtacgtaaaaaggaataagacatactatttgatcacacaacagggtgactatagtcaataataacttcactgtacatttttaaataactaaaatagtgtaattatattgtgcataagacaaagtaaaaatgcttgaggggatagatactccattctccataatatgcttatttccaattgcatccctgtatcaaagtatctcatgtactccacaaatatatacatttactaggtaaccacaaaaatttttaaaaattgaaaatttaaaaatttgaaagatatacttaatggaaaaacaagcaatttgtaatacaattattttatgtaataaacaattaggggacaggtttcaaaaactattgacttggatttagtaacaacagtaagtattagcaattatcatgattgtactattagtcattctttcacttgtcctacttccctaccaactcttccgtttcctggtggcactattaatttcccttaatgtacatgggaaaattattaaaatataaagttagattgctttgaatttttattagtatttcatcaacttttatctcacgagaaagttaccatgtagaccttatataatttgcattcaacatggatattatgttttagccattgaataagattttagttgtatgttgatgctaataagaaggtaaacagaaatgatcccctaagagactgtataataatgttgcaaagaataattgctatctatatatatcttaaaagtgtgatattaatttaaaacacatgagattcttgtgttctctcataaggaatattctatagaataaataattgttattatgaactaagggcacttttcagatacaagtggtagaaattatttggtttttattaggcaagcacttttcatttttttcttggattctctgagatgcaggtatgacgttgagacataagttgccccagggagctttcctgagttgtcctgcaggcttggcataaggtggaaaaacacctgttcttatagggtaaaatgacctttttttgctgtaacatgtagacctctggaatctcagggatgaatggtttaaatgctggagtgaaagcaagtaaacactgggttttgttgcaaatattttgggggcacaatttctttttatgttgaagaatggtgtacattttaagctagaatactggtgaagagccccaatccttacaatacatcattagcatttcaccttgctcatctgtttgcaaaaacttctgcttctgcttttaaacaagtccacaggatatctgtcatctataacattgctagagaatgtaatgttgatgtgctagatgataatcagtatctattaaatgaggaatgatatctcaggtgactggcatatgataggtaattaatgttattggaaataacaaaaataaccaaaattgcaatattaatatttctggatcactgacttagtgccagacacattttaagtgttttacctgctttaacttttttccacaatacaatataaagctggcaaaagtacacataaatatctctatcaacatgctggtatatttttctatcatttgctgcctgattttattaaaaaaattctaaattgtgtattctttttattctgaccctctgcagtctaattcattgaatatcttggaaactttttaaaggaaggaaatataatcagatctctccatttgttaactctttttagtagcttcccaatgccataataaatatttcaagatcctaataattatttggctccaacttgcctcttcagaatcatctgtttcttagtattcttctgcaaactaaacttgaagacttgagaactgtctttactactttgcctgcttttccttttgtgtcttcctctccccctcattcatcacctatttcttcacacctttcagttctcatcttgattatccatgtctccagtatactttctgttatcccaactggatatatccttgttattgtggtactgaagataatgcttttcacacattttattacttgcttatattttatctttcaacatagagtttaaggaatgtggggacagaaactatgtctacttttcttgtcttcttaaaatccaaagcagtggtttgtgtgaagcactttataagaagtattgtttggttgaataactaatactttcttatatgttgcaaaatgaaggctttaatttgaacattactaggttcagatagtctctagtagtactcttttttctgtagtaataatgaaattcatataattgtgatgatatagaaataggaatctttaattggcatctggtttaccccacccactaaacatctttctttcacttcaagcaaaaacactgaaagaagaatatagtatcattcccaccaaaaatttaagacaaacaaaacaaaacaaaacaaaacaaacaggtttttttttttttttttttttttttttttttacctttggcagggattttgcaggtttgccgtgaagttttccaacaaagtgaacattttgtaagtgtgggtgaggaaattaaaaattcctgtagttttgaagaagctttgtttcacttttctccattatctcagataatgtagtattttttcataatgggaaaaaggaaaacaaaggcatatgacacaagataattgttatgagaatacaactgataattatctgaaaggagttagaataatgtagccaaagatatataaattgtctatgcttagataaaacaatatacatgtatttatacctggggataatttagtttttgtgcattatctattttgctcatatgtatttacaagaaagaccaagtgctaagagaattgtgggagaaaacttattcttctatcacatcagtgtattcgccatcgtaaaccataattaaaataaaccttagagaataaaacatgcatttgtttactctataaagcagcaatagtaatagatatacacttaaaacaagtctttgaggtccatgatcaatggattctactctactcataaaaaacaattttctaagaagtactcaatttttttcaaaaattaagctagtcccttgatcttttgttcttcaagtgaactgttgagtattttgtgagtatggctgaaatccttgtacctactactgctttgggttcatgctaaggtcttaataatgttagattttaagtaaacatattgtcaaatagcagctgaaattttttcagaaattattgaaatagagacttttgcctaacatggatttcactcatattgttcttagtgaagagacatagttaaaaaaaaaactatacagaagtaacttgatgttcacatttcaacagatgtttgactttaagacaaatgattttcaatcctttagtgaaggagtataaagatactagaaacttcaaattacctgcattgatttttgagtctttgatagagaaattgtatcgttcaattgtgaaggaaacattatggtactgtgggaaaatattttaatttctaaataagggacctgagatacacaattcaaaacaatcccctcaatgctaactagatagttgtgctagaaaaatgcataactcctcaatctacatgtctgcattcagcaggatgtttcttgatgtgtctaatgacttttcttaaatgaaaaatatgtcaagtaaaatggatgtgtgattgctgaaagaaatcctaatgacattaatttataggtttatgagttcctggagtgtgctgtattagtgatgaccacagggttctaacagatgctataatgtaagtctttccataatatttgtgagattgatagattattttatattttcatttcctcatttcttttattgaaaaacagtacttctctgactttatacgtacttaccttctgttttagttaattttcacactgttgacaaagacatactcaagatgggataaaaagaagtttgaaggactcacagttccacgtggctgggaaggcatcacaatcatggtggaatgcaaagagcaagccacgtcttacatggatggcagcaggcaaagagagagaacttgtgcagggaaactaccccttataaaaccatcagctattgtcagacttattcactatcatgagaacagcacaggaaagacctgcctccatgattcaattacctcttactaggaccctctcacagcacatgggaatacaagatgagatgtgggtggggacacagtcaagccatgtcattctgcccctggcccctcccaaatctcatgtccccacatttcaaaaccaatcatgccttacagacagtcctccaaagtcttaactaatttcagtattaactcagaggtccacagcccaaagtctcatctgagatgagacaagtgtcttctgcctatgaacctgtagaatcaaaagcaagttagttaattcccagatacaatgagggtaccagcattggataaatacagatatttcaaatgggagaaattggctaaaatgaaggggctacaggccccatgcatgccagaaatccaacagggcagtcattaagccttaaaattacaaaatgatcttttttgacttcatgtctcacatccaggtcacactgatgcaagaggtgggtttccatggccttgggcagctccacacctgtggctttgcagggtgcagcctccctcccagctgctttaaagggctggcattgagtgtctttagcttttccaggtgcatggtgcaagttgttggtggatctaccactcaggtgtctggaggatggtggcccttttctcacagctcctttaggcagtgtctgagaagcaactcagtgggagttccaactccacattttccttcttgaagtccctaggctacacagaatactgggacgatttttttctttctagcccaccaggcctgtgatggaaggggctgccgtgaaggcctgacatgctctgaagacatttcccccattgtcttggtgattaacatttggctcctcattacttatgcaaatttctgcagccagcttgaatttttcctcagaagaagttaactcttatggtttaatgtaaacacagtatattaaaagtctaagtatgtgcatggcaaagagacaaacaacttgctctttacttgagtctttaatgtcccttttatgtttgtaaatgctattatccaggtagtatcaataattttgtgtggatgagtcacttattttatgtaatatattttacaatagtgtcaagaacattcacagtgagaagttcctttagttctgcaatcactttgagatggaattaaagatgaaaataattatatgagtatatcagcatttcttggatattgtgcttcaaggaattttttggtaaaagttgacatataattgctatgctatacaatttactgattattttgtaaaatccattatttgtggtatattcacagaattgtacatccatgacaacaatcagtttcagagcacttttatttgtatcacaaaataaaccctgtactctttagtattttttcctcaccctgagtttctgcatttctcctgccctgctcaattgctaattaaatttgtatctatagatttgcctattctggaaattttaaaataaatataatcgtacaatatatagtttcttgtgactggcttccttcatttagcataacattttaaaggttcatttatgatgtagcatatgtaaggacttcattcctttttaatggcaaaataaacattttatatatgagcatacacattttatcgatttatttatcagttgatggacattaatttttccctatttttggctagtatgaataatgatgcttatgaacaagcttagtgtaactgtgttttcatttctgtcagatacatattcttagaagtagaattgctgtgttgtgtttccttgcatgtttagctataaaaggttaaactgtacgtgtaaacttttgagaaattgctagactgttttccaatgtggttgcaccattttccattcccatcagcaatgtgtaagtgttacaatgtctccacatcgttttcaacaaatgattatgtgtctttttattacagctaggctggtgggttgaagtagtgtcttgtggggaaaagaaagagagatcagactgttactgtgtctatgtagaaagaagtagacataagagactccattttgttctgtactaagaaaaaatcttctgccttgagatgcagttaatcgataacactagccccaaccctgtgctggcagagacacgtgctgtgttgactcaaggtttaatggatttagggctatgcagtatgtgctttgttaaacaagtgcttgaaggcaatatgtttgttagaagtcatcaccactctctaatctcaagtacccaggcacacaatacactgcggaaggccacagggacctctgcttaggaaagccaggtattgtaaaaggtttctccccatgcgatagcctgagatatggcctcgtgggaagggaaagacctgaccgtcccccagcccaacacccgtaaagggtctgtgctgaggaggattagtaaaagaggaaggcctctttgcagttgagataagaggaagtcatctgtctcctgctaatccctgggcaatggaatgtctcattgtaaaacccgattgcatgttccatttactaagataggagaaaaccaccttagggctggaggtaagacatgctggtgacaatactgctctttaatgcaccgagatgtttatgtatgtgcacatcaaagcacagcaccttttcttaaccttgtttatgacacagagacatttgttcacatgttttcctgctgaccctctccccactataaccctattgtcctgccacatccccctctcgagatagtagagataatgatcaaaaaatactgagggaactcagagaccagtgccagtgtgggtcctctgtatgctaagtgccggtccccagggcccacttttctttctctatactttgtctctctgtctctttcttttctcagtctcttggcccacctgacaagaaacacccacaggtgtggaggggctggcccccttcagtatctcattgttgattatatttccttggtgtctaatgatgttgaacattttgactttgcttataagccactgtattttttttcttttttggagaaatttctattcacatccattgcccatttttaattaatttctttttcttattaagttgtaagtcgtatttctgatacaagtacttcattagttatatcatttgaaaatagattctaagattatgtgggcttttgttttcttgatgctgtcctttgaagcacaaaagtactaaatttgataaagacctatttatatatttttcatatttgattgcttatgcttttgatgtcatatgtaagaaaccactgccaaattcaaagccatgaagattatcttctgtgtgttctttttggaattttatgattctacctcttaaatttaagcctttgacctacttttagtagttttgtaaatggcttgagaccagaagtcaaactttattcttttgtttgtgggcaatccgttattcaataagcatttgttcaagactgttcaattttttcattgaattgttttggcatctttgtaaaaaaccataaatatgtgggtatgtttctgggttctaaaatctattttgtttgtatatatgtctatttgtatgcctataccaggctcatttgattattatagatttgtagttggctttgaaagaagaaagtgtaaatcttccaactttgttattattattattattattttcagacaggatcttactctgtttcccaggctgaagtagagtggtgtgatcatggctcactgcagccttgaactcccaggctcaagcaatcctatcaccttagcctactgagttgctaggaccacaggcatgtgtcacctctcctggctaatatattattattagtattataaagacaagagtctccttatgttgcccaggctggtcttaaactcctttgctcaagtgatctacctgccttggcatcacaaagtacaactttgttctttattttaagacttttttggctatctttaggtttcttgaatatctttgtgaatttcagaattagtttgtcaatttactggaagaagccagttgggattttgatagggattgcattaaatctgtatatctatttggggagtggagtatggacactacaacaatactgtgttttaatctgtgaacatgagatgtctttccatttatttacatcttttaaatttctttcctctatgctttacagtatccataatgcaagttttacacttattttgttaaaattgattcctaatagttatattcttttggatgttatttgaagtgcaattgttttcttaatttcattttggatatttcattgcaattatgtaaagtaatttttttgtttattgatcttttatcctgaaaatttgctttgtttattgttccaatattttttctagcagattcctaaagattttctagatgtaaggtcatgtcatatgccaaaagtttaacttctttcttttcaatgtagatttatttttttcattttcttgcctttatcttgactagaagctccattaaaatattcaatatagataaagagtggatttagtctttctccattaagtatgatgttagctgtgcattttttacagataacacttaccagtttgagaaagtttccctctatccctactttacggggtactgttataatgaaggatattgaattttattaaattaatttttctgcatttattgagatgatcatgcagttttatttttctgttctaattacattttgtattatgttaatagagattttaacgttaaagcaactttgcatttttaataaaacttttacttattcagggtatataattgcttctgtatattcttacattcattttgctagcaaattttgtggatttctgagttcataatcataagatttatcgatctgtagtttttattttttgtgatatctttgtgtggttttactagaaggaattagttaaatatgttgataatgcatttttcttttctgtgatttgaaggattatttttgaggaattgttaatttttctgctttaaatgacttatagatttcaaaataaaggcatcttgacctaggcaattctttgtgggttgtattttggaccaattcagcctctctttttgttataggtctattcagatgttctgtttctttttgaatcagtttaatatattttcttgtctgtgtcttcctgtagtagaatttatgtcaaattaagttgggagtgggtgagggagcagttcatggttgaaattaataggctctcattatttttaccaggacttagtagattttcttgaataaatattgctaatattacgctttataattttaggtcaatgcctggacactttaattttttatagaaaacacaatattttaatgctaaagatgtgtttaaattgtttcttttttacaattgtgatgttctatgaagatttaaacttttgactgttaacagatgatttaaatagaaatgtagcatatgtactcagtgtacatgtgtatattcagcttgtcagcattgagttatctttcataaacttatatttatttatttgacacaaccaggtgggaggggttcccagagaaacaccagagagcctgtgcactgggaggagtgcacactggggtggagccacagaagttcatatgatttgcagtgaggaggagcccggcccctcctcttcttggatggaacctggaattcagtctgtgaggtggcaaacccaccggcaggaaaacacactctctcacttcactaagagcctctgttttgccttttcttcctttttacctaacaaaactctgcattattcaccttcaaagtccgtgtgcctaatttttcatggccatgtgacaagaaccttgcttttagttgaactaagaaaaagtcccacaacatatagatacacacacacgcacacacacacacaggcaaaaatgcaaaaacattcctcattttattttgttttacagatatggtcttttttacaaattgaaagcttattgctgccctgcattgggcaagtttaccagtgccatctttccaacaggatgtgctaactctgtcactgtggcacattttggtaaatttcacaaagttccaaacatttttattattattatatttattatgatgagttgtgataactgattgttgattttactgtagtattgtgttgcgggcaccagaaactgtattgggataatacgataaacttaactgataagtgctggtgtcttctgactgctctaccaaccagcctttcccccatttctctctctctccttaggcctctctatttcccgaggcacagcaatgttgaaatcaggcaaattagtaatcctacaaatggcctctaaatgttcaagggaaaggaaggctctgtcatctcaatatcaaaagctggaaatgattaaacttattaagaaaggcatgttgaaagctgatacaggctcagatctgtacctcttatgccaaatagttagccaagttgtgaatataaaaaaaaaatttgggaaagacattaaaagtgctacacatgtacacatgaatgatatgaaagtgcaacagccttgttggctggataaaagatcaaaccagtgacaatagtccccaaatttagacaaagcctaaaccagaacaaggccataattctctccaatgctgacaggggtgaagaagaaatctttgaatctagcagtggttggttcacgaagtttaagggaataaaccatctccataacataaaagtgcaaaataaaagaagctacagaagattatccagaagatgtagccaaaatagttactgaaagtggccacactaaacaggagatttttccttgtgtacagagcatctttctcttgaaagaagataacatttagcttttttatatcttcacaggagaagtcaatgtctagcttcaatgcttcaaaggacaggatgactctttcattagaggctaatgcagctggtggcttgaagttgaagccaattttttttttttttttagatggagtcttgctctgtcacccaggctggagtgcagtggcaccatctcagttcagtgcaagctccacctcccaggttcatgccattctcctgcctcagcctcccgagtagctgagactacaggcaaccgccaccacgcctggctaattttttgtatttttagtagagacggggtttcactgtggtcttgatctcctgacttcatgatccacccacctcggcctcccaaagtggtgggattacaggcatgagccaccgcacccggttgaagtcactgtttatttaccatttggaatatcctagggccttagataaattattctaaatctactctctctgtgctctattaatggaatatcaaagcttggttgataacacatttctttacagcataaattactaaatattttaatcccactgttgagatctattgaccagaaagaaatattcctttagaaatattagcattcattgacaatgtacctggtcacccaagagctcttatggagatatacagggagatcaatgttgtttttatgcctggtaatacaacattcattctgtaacacatatatcaaaaagtaatttcaacttttaagtcaattaaggaataagtttcgtaagattattgctgccattaacagcaatttctctgttggacgttgtcaaagtaaattcaacactttctggaaaagtttcacctttctagatgatattaagaacatttgagtcattaaatgaagtaaacatatcaacattaacaggaatttggcagaatttgatttcaaatatcatagataatgttgagagcttcaagaattcaatggaagaagtaaccacagatatggtagaaatagtaagggaactattactggaattaaaagaagaacctgaagttgtgactgaattgctataatctcatgataaaacttgaatagatgagttctttcttatggatcagcaaaaaaatttggtatagtgagatagaacctactcctggtgaagatgctgtgaacattgttgaaatgacaacaaagtatttagaatattacttaaggttatttgataaagcagcagtagggtttaagtggattgattccaactttaaaagaagttctatcatgagtaaaatgctaccaaattgcattgcatgctgcagataaatccaagtcaaaatcacaatgagatgctaactcaagccagtcagaatggctatttttaataagtcaaaaacaacagatgctggtgagattgtggagaaaaaggaacacttttacactgttggtgagagtttaaatttgttcaaccattgtgaaagacagtgtggtgattcctgaaagacctagaggcagaaatataatttttcccagcaatcccattactaggtgtatacccaaagtaacataaattgttctattataaagacacatgcatgcatatgttcgttgtggcaatattcacaatagcaaagacatggactcaacctaaatgcccatcaatgacagactggacaaagaaaatgtggtacatattctccttggaatactatgcatccctaaaaaagaatgagatcatatcctttgcagggacatggttggagttggaggctgttattcatagcaaaataatgcagaaacagataaccaaataccacatgtcctaacttatatgtgatagctaaataatgagaagatatggatacatggggggtaaaaacacacagtggggacttttggaggtcaggggatgcgaggagggagaggatcagaaagaatagctaatggattctaggcttaatacctgggtaatgggatgatctgtgcagcaaaccacgatggcacacgtttaccttgtaacaaacctggacatcctgcacatgtaccttgaactttaaataaaagttggaaatttttaaagaaggaaggtcaatgggtgcagcaaacattatttttgtctttttaaaagacattgccacagctccccaaactttcagcagccaccaccctgattagttagcagctgtcatcatcaatgcaagaccctccacctacaaaatgattacaactcactgcaggctcagatgattgttaggatttttaaagcaatgaagtattttcattacagtgtgtacattatttgtaacatatttatattgcagacttaagagactacagtatagtgtacacataacatctatatgccatggaaaaccagaaaattttgtttgacttactttacttcagtgttctgggaccaaatctgcaatatcttggaagtatgtcttgtataagtgaaaataaaatgagatctactcttttaaaagtattttaagtgtatgatacattattgttaactatggccacaatgttgtgcagcagtgctctgaaacctgctcatcttatttttactggaactttatactcattgaaaagcaactctcaatttcctccattctccagccactggtaacctccattctactctccgtttctttgagtttgactgtttcaaatttcttacacaagtagaatcatagagtatgtgtcccattgagactggcttatttcacttaaaattatttcctgaaggttcatctatgttgttacatattgcaggatgggtggatcatatggaagttctatttttaattttttgagcaacctctacactgttttcattttggctgtaaaaatttatattcacactgacagtgtatgaaagtttcaatttctccatttcctagccaacaacttttattgtgtgtgtatatatgtatgtgtgtgtttgtgtctgtatgttgataaagacatggtaagaggtatgaggtgatatctcattgcagttttgattttcctgatgatgaatttacattaattagttttcatacagctgttgtccatatgtacaacttcctcagagaaatgtctttttcaagtatttgcctatttattaatcatggctttttttctctttttgctattgagttgttgcagttcctaatatattttaggtgttaacctctcatgagatatatgatttgaaactgtttcccattcccattttatcttttcactctgttgacttctttgccctgcagaaactttttagtttgatacaattctactttcatatatttgaccttgttacctgtacttctgaggtcatacccaatagaccattgcccagcccaatgtcataaaactttttccgtgttttattgtgagagttttatagtttcagggcttatgtttaagtctttcatttgttttgtgttgatttttgtatatgacataaactaagggtccaattttattcttttgcatgtggacatctggtgttctcatgcagtaccgtttcttgaagagagtgacatttattgagtatatttgagactcattgaatataagtgcattgtatatttgtgactttatcatctgggctctctattctgttacttaaatctctctctatttatgtctttatgtgaatatcatgttattttaataactgtagcttttaatatattttgaaataaggagatgtgatgccctataactgtgttttacttttcccacattgttttggctagttacttcttcctggatcattatacattttaagatttttttgtctttgtataagtcattggtgtttcgatagagattacatttaatatgttaatcactttaggttgtatagatgtttctgtaacattaaatcttccggtcaatatactatgtctttctaaattagtataatctttaatttcattcatcagtgttttgtagtttttagtatacatgtctttcttccacttgttacagtttattcttatgtattttgtcctttttgaggccattgcaaattggagtgttttgttaatttccttttctgatagttctttgttaatacacagaaaggtaagtgatttttgtatgctgattttatatgctgcaaatttactgaatttatgcacttgttctaataatatttggtggcatctttagggttttccacatataatatcatgtcctctgcaaacagaggttattttactgttgattcagaagcctgttgctttttttctttttcttgcctaattgttccggctaggatttccagtatggtgtataatagaagcagcaagagtgaacatcctttccttattgtgaaaacagatgaaaagttttcagtttttttttaatcattgagtatgatgttagctatgagcttttcatatattgcctttatcaggttaagataatttccttctatttcttgttgcaggaagtcagggaccctgaatggagggactggctggagctgaggcagaacatcataaattgtgaagatttcatggacatttatctgttccaaaaattaatacttttataatttcttatgcctgtctttactgcaatctctgaacataaattgtgaagatttcatggacatttatcacttccctaataatactattataatttcttacgcttgtctttactttaatctcttagtcctgttgtcttcataagttgagaatgtatgtcacctcaggaccactattgtacaaattggttgtagaacatgtgtgtttgaacaatatgacatctgtttgtaaaacatatatgtttgaacaatatgaaatcagtgtaccctgaaaaacaacagaataacagcaattttcagggaacaagggaagataaccataaggtctgactgcctgaggggttgggcagaataagccatatgtttcttcttgcagaaagcctataaatggatgtgcaaggaggagaaataccgctgaattcttttcccagcaaggagtaaccctggggaaggaatgcattcctggggagaggtctatgaatggccactctgggagtgtctgtcttatgcggttgagaaaaggactgaaatatgccctggtctcctgcagtaccctcaggcttactaggattgggaaattccagcctggtaaattctagctagactagttctctgctctcaaaccctgtttcctgttaagatgtttataaaaacaatatgggaacagcaggacatagagcctcatcagtaattctaattctgcctttgccttgtgatctatatggccctttgaagcatgtgatccttgtgacctactccctgtttatacaccccctcctcttttaaaatccctaataaaaacttgctggttttgcagctcagggtcgtctgcacagtcctaccaatatgcgatgtcaaccctggaggcccagctgtaaaatttctctctttttactcttactctttatttctcagaccagtcaccaattagggaaaatagaaaagacctacattgaaatattgggggcttgttcccccgatatcatttctatttctagtttgtttagagctctcttttaaaaactcataaacaattgatttttttcaaatgctttgttttgcatttactgatatatcaagtgatttttatgcatcattgggttaaggtgatatgtcacatttgctcatttttgtgtgttctattatccttaaatctagggataaatttgtcatttcttttaggaaagaagcaatgctgagtcttgaacatagtaaaagccaagcaacactactggtcttgtaatatcaaaaggaagagtgagactttcttcacaatttaattattgagtagtttctttgcaacagtaaaaacaacaaaattctgctgaaaatgaaaccaaagaattctgagtatttgaaaaatggtattaatattgtgaacggatgtcttaatattgggtcaatgtataaagtgtgaaacacagctcagtaatttttgtgcatgtgccacttgtgaatagaataatgtatttcacataaacccatatggttttacattattttttatttttccttgtttttaagtatttgactaagaatatttctaacttttaaataggtactaaatctctggaaaataaattttgacctaacagtgtaagttataaaaatatgttttgtcacaggaggaaggaaatcctctgtatcaacctcttcatgctggaattaactgaaggaattctatcttttggtcattccagcttcaagccttttatgtaactaatcccttttctccttctttcctgttttagcaaactttcagaaagaaaacaggcaacatcttgtgatgatgaagatcacagttgacacataggccagcaggaacctaatcacatgcaagttgtggtattggaaccaggtgaggtcgtgggctgcaacccgaaggtgcttggctcctttgtgctgcatgacaaactcaatccagaaggctgcttgatccaggggcttaattggcaaatcatggcgaattattgataacttcatagcattctctttgtagctgaaggataaacataaaaataccaacattgaaagtaaatttatttcctaagtctatggatggtctttgaaaagtgtcacatcaatgcttcaaagtaaatattatagaattgtcataggaatcgaatgttttggtttggacaaatgtagaaagtttattttttaaaatggaattttataaagaaaaatatgtcttaaattaaaaatggaaggtctgatgagaaagttaatgtctttgtagcagaggaaatattttgagccattctatgtgctacaggtaagacagtggaaatgcaatctgagattgatcatcttgatattttattttatttttttttgagaaagagtctttctctacggcccagattggagtgcagtggcatgattatgggtcacagcagcctccacagtgtgggcttaaacaatcctcccacctctgcctcctgagtagctgggactgcaggcatgcaccactttgcccagtaatttttaaatatttttttgtagagatggagtcctaccagtttgcccaggatggtttcaaactcttgggctcaagtgatccttttgctttagccttccaaatttctgggactacaggtgtgaactacctttatcgacccattttgatatttttaaggaaaaattgtttcacagctggtgtaatatttctaaattagtctttctctttctaccctactattctgtgttctaccatattttcctctcagtagtcagaataattttttgaaataaaagccagattatggcattcctctgataagattttcacctggcttctcactatattaagaataaaatctaaatctgtctttgttctacagaaccctacatggtcaggcatgggcaacttcttctaacactttccccaaccaccttctctcctagaggcattgcccttctattgttctttgagctccccaatgtgttctcacctgagcccctttacaccctttatcccctctctccctctcttggaatattcctccttgcaacaacttgaggcttgcttctatatctttttgaggcttccccttaaataatacctgttaaagaggcttttcgtggccacactatggtagtacctgtaggatttcctctattgttttgtgcttattttgctgtttaactcctggaacttaaaaatatgttacatgtcttctcaaataaaactttaagtataaaatacataaatgtacacaaattcagtgaatagctcaaaattttaacattaccttgaacaatatcctgatgtgaacaccaacttacctactacgcagattataatataagacatcacaacctgcctagaaaaactctgtcttcttgggccattttagtcactacttttgtcctcaagttaaaactaccttgacttctaatagattaatattgcttgtttacataatgaattatataatatatactcatttgtgtctttttttgggtagaagttattggctaattccattgctgtaatatgattcagtcaattgacaaataccacagattatctcctatttttatgactgatggatatttgggttgttaagatttttgaacactattactaattctggggtaagcaaatgtgtgtatatcattagatatacatattaatacatttttgatgggtatatacttgagagatgagttgctgagaaaaagatgcatgtagaattatgatgttttgttgactagctttttaaatacacaaatttaatttccaaaatttagagttgttttttaagttataattttttggataatttcgaatttatttctagtatggctagagcatttcctttttatgcttttgaatcttatcacatttgctaagtcctgatttttggcccagcagaagttcaattcactaactattccatatactcttaataaacgtatattctcaatatacattcacactcacctccacacctccacacataaaaatgtgtgtgtatatatatatatatacacacatatacacaaacttactatatatatacacaatacatatatatgtatacacacacatatatacaataggttatatttatgctcttcaaatgtttatttttaagtcacttttttttctctgtttaaatttagtatgagttctagtagattcacttttaaatctactatcttattctgtattttattttctgttttccaatctgctgtatgtttcttttctaattctttcctgtttgcttttaaactatttttaatcattcactgtcttattatcttcctggtaaggtattttcagtatattttctaagatggtacctccttatatatattgacaatagtaatcaatagtcacagcattttctacattatttcttttggagcacagaaaaattattacagatttattttctcaatattaaaactttgtgcttcaagggacatcttcaataaagtaaaaaaaaagaatcaacctataaagagtgggagaaaatatttaaaaatcatagactgacaaggcattccaccaataatataaaaataattcttatgaatcaataataagataaaaatgttagaaatgttcaaaagataggaataaaattttctcaaaagaagacgaatgacttgccagtaagtgcatgaaaagatggttatgtctttagccacaaggaaaatgcaaattaaatccacaatgaaagatcattttatatccactgggatccctgtaacaaaaagataggagataacaagtgtagggaagagcatgaagaaattggaaccctcctgtacagctagaagtaacgaaaaacggtgcaagtactttgaaaaacagtttagcagttcttcataaacatcaactttccatatggctcagaaattccactcctagtatcttctcaaaattagtgaaaacaacttttttcacaaaaaatatgtatagcagtgtttataagagctaaaattggaaataactgaaatgtctgaaagctgataaatgggtaaattcaaaatggtacattcatcaaagaatattagcaataaaaagaaaaaatgttctgacactttcaacaatatgggtgaaactaataaaagacattgtactaagtcaaagaaatcatttatagaacactgtaaattgtatgatttaatttacatgaaatatccagagagaataatctattgagaaagtaagttgatatttccctaggactggaggtttatcaacagtgattttatgcattttgaggtttattttagggtgataaaaatgttcaaaaattatattatggtgatggctttgtaactatgtaaatgtactaactacttttagatctcacttttaaataggtaaatattatgctatgcaaattgtatcttaaaataatgataatactaaaaatacattattgagcatgaatacagttatactttcagaaattttatgtattgaattgaaatactttattttatttctccaagttcattatttcattgtattataatccatcattcaaaaaacttatattttaaacaattatctatatatgtttaaaaatatttgtgtgtagaaggttgttacagtaattggtgacccattaaatatatgggatcaaatgtaactaaaataattggtgaaaaataaaagcaggtttcaagttggttaaattatttaaattctttcaaaattggtctcctaaaaggggtaagacatgtattcagtgttgtcaaaagaatctgtaaataccacatagtaaaaaaaattgtcatactcacacagggtcattaatgactgtcttcagtgcattgagcaaatctgtacttgacatggtcctgatgtccacattgagggccttcatgtgagcaatgttatcaggttgatctgcaaacaaaggaatgcccaccatagggatcccatggtagattgcctcatagatgccactggtttcaccatgagtcataaaagatttagtttttggatgacctaggattggataaattttagcaaaattattcataagactaaaatgagaaatgcacaatagaatgctctgaaaggggcagtgtctactaaataacagattattatacacatcaaactccattagaattgctttcggatttcagagaaagaagcacctaattcttctggaggtaagtgaaggctacatgaagaggtgggggcgtgtgtgacttcagactcaaaaaatgaattgatattgccaggtggacaaaatgaaaaagcacattctgaatgaaaaaaatgtgcaaaaaaaaagagaaaagaaaatcaataatattgtgtatgttagagcattttcccttaaatacatactgcggtctgagtgggatatgtggtgtatgcaaggcaacagggagtgtggtggtggtattggaatagaagaaaggcaggccacattacatcaggaaacgtgttatcactttatgataaagattgaggatttaggccgggtgcggaggctcatgcctataatcccagcactttgagaggcagaggtgggtggatcacctgaggtcaggagttcgagaccagcctggccaacatggtgaaacctggtctctactaaaaatacaaaaattagagaggcttggtggcaggtgcctgtaatcccagctactcgggaagctgaggcaggagaatcgcttgaacctgggaggtgaaggttgcagtgagccaaggtcatgccaatgcactccagcctggggacaagagtgagacttcatctcaaaaaaaaaaaaagattgaggatttattttcagaaaatgcagagttattggtaataaaagaggcactgttattttttagtgtcttttgaaattaaccctgaagtagggaaaaggacaggtgtaaagctgtacaaataggagacagagagacaatccaggaagttattgggaaaccccgtgagaggtaattatatctgaaataaagataatttgattctgaacataaagaatgtgagtgtctataataaaataccaactatatagttattttcctggtaagactggaaaataaatataaagtagttagcctttatatttgagttttttgataataaatgttccgtaagtttctttcaggttgaactatccttctaattagctgttagtcatatattcagtatttgttctgcagagtattaccaagaaggtcattctgggatatccacttgtacagctgagtattggatgctaaagtatttggtctctttccatccacagaacctgttggggtaaagaaaatatcttgttccatgagtagaatgccaaagctataagatgttagaactctaaagaaattgtcaatcaactagttaaaccccttccatataatagatgaaaaaacgagaacaagcaattttaggaaatgagtactactaaaagactattgaatatccacatttcatgtcttttattatcaatttggtatattagaaaatcatgatgttttcaacagagaagcttagacacttgagagtatcaataaaaaattcaaaaatttaagaaattattagacagtcattataattctactgtaaaatacagtaacaaattagtgacaacctatacatttattttatgtattttatactacctgtaatcttccaaatttaatgttagtttatttcttgagtgaaatgagaagtgttacttatatatatttttctgtaagttattttgttagtgtttgacatctttgatttataaaaaacaaaatctataaaatcagctacctgtgagaaataaatcagtgctacataggtagtacatataacttcttgtagattacacattacccagcactacatccaagaaaaatttcaagtgacaatttctttcttttcttttcttttttcttttctttctttctttttttttttttttgagatggagtcttgctctgttgcccaggctggagtgcagtggcaccatctcagctcactgcaaccctcgcctcctgggttcaagcgatttttctgcctcagcctcccaagtagctgggattacaggcatgcactgccatgcccagctaatttttatattttttagtagagacggggtttcaccatgttggccgggctggtctcgaactcctgacctcaagtgatctgcccacctaggcatcccaaagtgcaagtggcaatttctgagtcaaattcaaagtactatcattttgctagttttggaaattcttccaatgtaggcgaaaagagccaattggcaatttatgaataagaatatacacactaaaaattgtaaaattatattttgctaaattttgcttaactgatcattaacacttagatgctgctataaagcatcgacagcatagattaatatgggctgctttagccaagccatacccatagacagtaccaaaataagatactgattttagattccccaagcaatccttataaactggagtgtaatttacaagtgttttccttgtatttgctatgtgagtgttaaagtaactttgtgtttccagaaaaaaattagcataggtcattaggagaaggctatgtcagagaggaaactaaaaagtaactcacaaatacacaaagacttcaagtgtattctgcatactacaaaataagttcctactatatttcatggagtgagggcatctgaacctctttccatgtctggcttccttctgcttgactccttcttatattcccttctccttcctccgttgggaggaggtgtttttctgatggttagagcagaggctttatgggaccacattttataatgcacggagtctaccctaaaagcaggattctgttccctccttttctatcatattttcctgtttaagacattagcaaggcccagtaaacagggcaggcaagttcttctgcttctctaaatctacttggctaggtggatacctccagaatagcggtttgtcagcctggacatcttttctctgaatgcattctgaattgcctactaaataggtctattccaaaatgtacaggaagtacaggagaccagattacctagcaagcctaaattgaatgatgcatttcagacttttttcaataccttattgttattgtaatagtgcagtaactgattaaaatgtaagtgattttaaataatatctatagtgtataccatgttctcaggaaacttgtaagcaaaagggacaaatgacagggcagaatttggtgatttctatgtacatgcctacaatactatgataataccacaacttcacctgcacctcttaaatatattttttctgatcacaatattaatgtcagaatttttatcaatcaaacacaccctcgttattttagtatcttccatatatatttttgtttttgaaccaatatctgagataattagagctatcatatcagttagtttttctggcagaaaatttctgtgattggactctttacagagtttaacagactcattcagtagctgtccaccattaagacattttatctaacctttcgtggaatctgggcaagagctgatgcaatcacgttggccctttcttctgtgatgttactgaccatagacttaagcaagactgccacgacaccattttctccagagctctgcacaaactcttccattttctgtgaagaatttgttctatcacaaaagagtgtcagcatagcaaacactatagaaaagattagtacatacatctaagaagagaaaatcaagcattatcagaaatttttggagtaatggctattttttaactgacctaatctctttctttggaagaagttatggaatatgatatacatggcatctgttatggctatttgtgtaaatatgtgtgtctgtaaaaggaaaagatgaaaaacaactatgacactatagaagaaggagacaatgctagaaaatattatacccagactcttcatttacaatactgtaattactaatatgggttcttggaaggtggcatttgttgtgtttaattccatatgttgtagttctactaaattccttgtgtctattaaggcagggttttttgtttgtttgtttgtttgttctttctgtagagtatttttagttgggagtcattggaaccattacctggctatgagcagtgaggaaaagttactattgaaataattttatatgtctatttctttagctctgtaattctttatacctcatttaaaacttgtcagattatgtctttttccctaaaaaaaaatctttaaaagctgaagtttaataatgatggagattcaagagtctgatactgtggtgtgaaatttctgtgaactagtcctgagaatcccatttataatacagaattatgcagtatatagttacataactgagtgattgtatttctcaggtcattgtttaaatattactaagacactttttttcctgaaatcacactgcataaaatgatatgctactggccaggcatggtggctcacacctgtaatcctagcactttgggaggtcgagatgggcagatcaccaggtcaagagattgggaccatcctggccaacatggtgaaactctgtctctactaaaaatacaaaaattagctgggcgtggtggcacacacctgtaatcccagatactcgggaggctgcggcaggagaattgcttgaacccgggaggtggaggttgcagtgagccgagattgtgccgctgcactccagcctgggcgacccagcgagactccatctcaaaacaaaacaaaacaaaacaaacaaaccaaacaaacaactgatgtgctacctataactgcctgtgagggaccctcatcatcacttttctgtgtctcacaggggcacttaatcctcagtggaagaatctaccagtcatttttccagtggagatctcttcactatcttgagtagctcattcacacaatataaagcccttgttgaatatgtgtttgcttgaaatttattgagaattactctgaattgtggtttcccttatgttctcatttgtaaatgtaaatgcatagtgtaattccacattgctcagtgcatacgcctatcaagacaaaataaagagaaagagaaatgtagcgccaaaagttttcagtatataatgtcaaaattgaatacccatctttttgttgttgttgtttcttttgttttccatttattatttatttattttctctgtaaaataatgatgaacccattctgacataaccggtatactttcagatcctaaacatgggaggtaaactttcttttaaaaacttgtttaaaaaaagaaatcctaaagtttgtgtatgcacaacatattttgccaagtatttttcaaaaatataatttgagccttatgacattagttttaattggagagtcactgtactactattccaggtagttcttggggctcccaggtattctgtgtgactcgttacctgtgtgaacacaaagtatctgaaacagttctcaatttagaaagtttattttgccaaggataaggacatgctcatgacactgcctcagaaagtctcaatgacacgtgctcaaggtggttggggcacagcttggttttacacattttagcagacatgagacatcaatcaatatgcgtatgacgtacattggtttggtcaggaaaggtggggcaattcaaagtgatgccttcatgtcatagataagagttaaaaggttgcattcttttttgggtcttagatgagccttttgctgaatacacagtatacatatgagagaagggttgagaaatagtcacttatgccttagtctgactcagtaaatctgcattttttccataaacaatggtgaagggatggctttgagttctgtcctcttttgtccctcacctgtgaagataagctatcaatttacatttccagggtgaaattcaacagaaatgtttcaggttaaagattttgaggcccacaaggaatttcctcttgggaagattgtaagggaggtatgtaacttaaaaacaacaacaacaacaacaacaacaaaaacccaactttgtagctattttatttaggaataaaatgggaggcaggtttggctgatacagtttccagcttgacttccctttgacttagtgactttgggttttcaagattatttttctttcagacctgtagccacatttaatggaacttgtgtttgatgttttttctcaatgcctcgctgcccagagtcttcttcatccacccaatattgaggtagcatattgtctgtttatacactcatcagtgatctcattctgggatatcttcatgaaaataatatatcagtgtacaaaatattagagtatgaaaagcttaaaaaaattaaatttccctcatactctctgtctagagctattcctgatttaaatttgtatgcttttattatggtttttattctatttatataattcactgtgatgtttatttagataattttaatcttattgtatattccttttcatcctgcataaaaattgtgatctagttctattcatcattttgtttctcagtttccgacaattcttgtattatagctgacactgtaattatacatattttgataaaatgattgtaatggcatagaatgcatattgtatacatttttacatagtacccaatagtttttcaggccttctgcccttctcttccctctgtagtagtccccactgtctattgttcccatttttgtctatgtgtgccccaagcttagctcccacttttaagtgagaacacatagtatttagttttctgtttctgggttaattattctggttcatgtgtgtgtgtgtgtgcacaaatctccatgtatttgtttgtttatcttggctttaatctgtcattttattttcttttttcaaatgttgtctgcctatctatctatatatttatctatctaatctatctatctatctatctattatctatttatcatctatctatatatttaagaatgaggacatagaatgattcactgggatatctttgtatctgtgaaggacttagtatctggttggctttgatttttatgctgaacgcgtacaactactagaccttacctaaagggaaccaaaaatttcataaaaaagattatactttgatgtgttacatcaattctagttttctcattttaccctggtgaatttatttcaatttctttaaggaaaaactctctagtttttgtgtggaaagtgcaaagaggaacgtattatgtaatacagtaagggttagtgcatttcattttcatgtctttagtttcctttagtctgtaattatcccttcattttttgtctctgttaatttttgacttctagatgaattattgaccagttgttttgtagaatgattcttattttacatttgtttaatgttccttcatgattaagttgctatcacacattttttgaaagaatactgcagacatgttgttgtagtcttcacattacatcatttttgggcagcagatagtgttgatttgtcatgctggtgatactaactttgatttcttggttaagatgctgtctacaggtttattccctgtaaaattataatttctcattttggaattagaagtatcttgataggagactttgagactgtaaatatcctgtttccattacatcctttccctctaattttagcatccattcaaagataatttttgcctgaattaaattactgtggagtttgtctaatgattatttctatgtctataatttctttaacaattagtaagagaaattctactctaagaaagaacattttttcccttttatttccttatactggtttctgtcaatatgatttcatgagtatttggtttattccaaaggttacaatccacagctatcattattccattgctcaaattggtccagattcgattcattgggacttccttcagtttccttctatatttttctgatatgttgtcatcatgttgtatacttatttactttctggcacccctagatatttcaggcacatcctgtacttttgttgcctcaggggtaatgtcatttatatcttgaggaaggcatggttcgttttattggagtatagtgtctagaagcaaaatttcaagtacttagcatgttcattgcatctgggatattattacttctaggccatttacgcatagacattttggaaatgtatctatgcataacttttcattaacagcttaagagaataaataaattatcatttccataaaatacagaaaaaggagagtgtagtaagctaaaacatggtaaatctaaatagtaaatatttacagataagctcaaactaataatttaatgtaaaaagttattttcatttaatgtcatgtaatagttatatatcaatttaaaaaagaattaaataaactcacccattatggtagagattctcagatatttcaatctagcttttatttttgtttaaaagagaaacacctaataaaaattacccatattactataaaatatatacagattttacaagaggcatatacccaatagcaaataaatgaaaattgatgcaatgctacaaaaatcaaacaaagcagaattaagatgcgaagtatcaaatgtgataagtgaatcatttcatgtggatagaaataattcacttaaaattaacaataataagtatttggagattgaaatatatctcagaaactgatagattgaacagagaaaataaattctatgaaagttgattgtattagcaacaaaagtaacaaaaataacgtactgaatcctgcatcttcaaatagagtataaatattcttttgaagtgcacatgaaaacttttataaaattaaactaaggcaatgtcacagatgaaatctccacaaattctgaagtatatatatcatatgtatctatataatgtgatacaattaaaataattataaacttaaagagaatgtattacctttcaaatatacacatttaagaatttcattcagtggagtggactgtgcttaccattcatgacccaagtctttactaccttttctgctccaaacacatataccatgaagagaagacggcatagaatatactcaggtaagtatacaactgagaaaacttacacaccagttgttagcattagagaaaattatatgaatagattcttataggagctataacaagatggttttggcaggataaaaaatgtggcaaaagccttaaaagtggaaaacaaaatttacctacggagttcagggaatttctgttctgaaaaaatgtaagttgtaataactaaaaaattaaaacaaattataatgaaactgatctctctagatgacagcagacacatgcaggaaatgaaagtttgcagaaattaacagctgttgaagattaactcatgaaaaccacatgaggaaataaccaattctacacaatagtaagattttcacccaaagtttataaatataggaaaaaatcaaaataattttttttctcagagatgagaaaatacttaacataaaaatggaattgggtgagaagcatgaatagaaagaggaacatttagaaattgtggaaattagaaatacagtcactgattgtataaaatgtaatagagttcacaaaataaaatggaaccgaatgaacgaataaaagaatgaacaaaacctgcaataaggtgaattagtaaactttctctttttctgactgaaccttgactgatagagcttccaacagaaatcacctaatactgtaggaattgccattaagctgattaaaatatgaaagtgttatttgctattaccacatgttagagccctcctgattgcctgctttacttctgaagctctgtcattatggtttcctggttttaatcactcattctatgcttcactgaaatattttgaactgattcaatgtgtttctctcaaatttaattttattctatcctgtctcttgcctcctgcaggttctcactgtgagcaatccagctccagagcttaccttctctgacctagggttcctcatttttttttttttaccagtttatctgaacttcattgatcttgttcctttgccaatcactctgagccactgtcatcatgactcaggattctagaatttgaacaaattataaatttgccctttgtatcttctgtatcccaaagaagaaccagtagacggtaccacaagagaaaaatgagtgcagtacatgaacaaaacacctgaatgaatcacaaacaaaaagagatggttgattagatttataattaagcatttgccaatcaaatcagtgattcatttttatattatttggattggtaaaatttaacatccaccatagatgaagcacgaaataactgtccactccagtgctgcataggtgggtgtacatagagggaggtagtgtttgaaggatacccctgggctcaactgactcaagctagctcagtcttggtaagagggagactggacacttctggtacagttgggctgcagacacactgtaccaactgtaagttcactttggtgagaatcttcatatgccctcacttgaaagaattttcttttccagataagtttatgccttttattcatccgaattttaccatgatgctgtgctcaaagatacaacaacatttgaggcactaaaaaatgaaaaattttaaatattgttgtctgctctaacagttttcaatttactgaaggtggaaattttacagttattaagaaataaagtaaactgaaaaaacataggtggagtgagactgagagaaaaagaaatggagagagtcatggaactcttcccagcagggtgaaaattattggatatttattaagaaaagggatgaatgaaatgaaaattaacatggctaaaaaaaggtctcaacacaacattatgagaggtaaggtggtcaaatgagactttttgaaattaatccaacctaaaagggccccaaactaatcagtttcatttatcgcagtgtggagtagtttaaaaagcaggaatgcagagatcacagttagaaagctgcttaataatttcttcagataatgctgaggcagattaatcaagataaaaattaacacacaaaaaaagggtttattggtttaaggccctgctgttgacccaaagccttgtgtaagactgtcaggggatagggaacagaaattccagagactccttaatacaagaccccatgtgatatgctaccaagatgcattggggaagccttgaccgaggttatagttaggttgagaaaccataaaaatataaagattaatagaattatgaaatttgtgatatttaaacaggcttaatttaaagaaagtgtgtctttttaacttaaatgtcttatgaaatggactttatgtctggctggaaacacttgttctgcctattgataatattgtaacacaaaacctgctgataaagtcctaaaggagcttaagtaaaggttaatgaaatgaaaaggaaaatgtataggaaagttggtatttttgaacatactttatgtgaagtagtatctattttatctgaatgtgtcaaggttgaaggacactgtatctaactaggaaatgtttcttgaatctaatattgtataacagaaggtatgcaaatttgcccttcagccaacattaattggacatgctaaatgaaaaccactatggtagggtggagtcaagatggccgaataggaatagctccagtctacagctcccagcatgagcgacacagaagacgaatgatttctgcatttccaactgaggtaccaggtgtatctcgctgaggattgttggacagtgggtgcaggacagtgggtgcagtgcactgagcatgagccaaagcagggcgaggcatctcctcatctgggaagtgcaaggggtcagggaattccttttactaaccaaggaaagggtgacagatggcacctggaaaatctggtcacttccaccctaatactgtgcttttccgatggtcttagcaaatggcacaccaggaggttatatcccacacctggctcagaaggtcctacacccacggagtctcgctcattgctagcaaagcagtctgagatcaaactgcaaggtggcagcgaggctgggggaggggctcccacaattgccttttgtttggctatgccctgaccccagaggtggactctacagaggcaggcaggcctccttgagctgtggtgggctccacccagttcgaacttcccagccactttgtttactcaaaaccgctcaactatatggaaactgaacaacctgctcctgaatgactactgggtacataacaaagtgaaggcagaaataaagatgttctttgaaaccaatgagaacaaagacacaacataccagaatctctgggacacattcaaagcagtgtgtagagggaaatttgtagcactatataccctcaaaagaaagcaggaaagatctaaaactgacaacctaacatcataattaaaagaactagagaagcaagagcaaacacattcaaaagctagcagaaggcaaaaataactaagatcagaatggagctgaaggagatagagacacaaaaaacccttcaaaaaatcaatgaatccaggaactggttttatgaaagaatcaacaaaattaggagactgctagcaagactaataaagaagaaaagggagaagaatcaaatagatacaataaaaaatgataaaggggatatcaccaccgatcccacagaaatacaaactgccatcagagaatactataaacacctctatgcaaataaactagaaaatctggaagaaatagataaattcctcgacacaaacactctcccaagactaaaccaggaagaagttgaatgtcttaataggccaataagaggctctgaaattgaggcaataattaatagcttaccaaccaaaaaaagtccaggatcagacggattcacagcaaggacttcatgtctaaaacaccaaaagcaatggcaacaaaagccaaaattgacaaatgggatcttattaaactaaagagcttctgcacagcaaaagaaactaccgtcggagtgaacaggcaacctacagaatgggagaaaatttttgcattctacttatctgacaaagggctaatatccagaatctacaatgaactcaaacaaatttacaagaaaaaaacaaccccatcaaaaagtgggcgaaggatatgaacagacacttctcaaaagaagacatttatgcagccaacagacacatgaaaaaatgctcatcatcactggccatcagagaaatgcaaatcaaaaccacaatgagataccatctcacaccagttagaatggcaatcattaaaaattcaggaaacaacaggtgctgaagagggtgtggagaaataggaacacttttacactgttggtgggactgtaaactagttcaaccattgtggaagtcagtgtggtgattcctcagggttctagaactaggaataccatttgacccagccatcccattactgggtatatacccaaagaactttgaaacatgctgctataaagacacatgcacatgtctgtttatagtggcactattcacaatagcaaagacttggaaccaacccaaatgtccaataatgatagattggattaagaaaatgtgtcacatatacaccatggaatactatgcagccataaaaaatgatgagttcctgtcctttgtagggacatggatgaagctggaaaccatcattctcagcaagctatcacaaggaaaaaaaaccaaacaccgcatgttctcactcataggtgggaatagaacaatgagaacacatggacacaggaaggggaacatcacacactggggcctgttgtggggtgggggcagtggggagggatagcattaggagatatacctaatgttaaatgatgagttaatgggtgcagcacactaacatgacacatgtatacatatgtaacaaacctgcacattgtgtacatgtaccctaaaacttcaagaataaaaaaaaaagagtttttcaggatgatggtccatcctgaagtacataggaaaaaaaaaaaaaaggaaaccactatggtattccaagttcatacaatgtagaatagaagctggagtgttagtacagaaagcattatctgttcgatagcccggataaacaacttcaggaaagtttcaggatgcaaaatcaatgtgcaagaatcactagcagtcctatataccaacaaaatccaagtcaagagccaaatcaggaacacaatcccattcacaactgccacaaaaaataaaataaaatgtctagaaatacagtttaccagggatgtaaaatatctttacaaggatcactacaaaccactgctcaagaaatcagagatgatacaaacaaatggaaaaaaaatccatgctcatgggtaggaagaatcagtatcattaaaatggttatactgcccaaagcaatttgtagatttcatgctattcttatcaaactgtcaatgacatttttcaaagaattagaaaaatgtattttaaaattcatatggaaccaaaaataaaaagcccaaatagccaaggcaattgtaagcaaaaagaatgaagctggaggtatcatattacctgatttcaaactatgctacagggccacagtaaccaaaacagcatgatactagtataaaaacagatacgtggatcaatgggacagaatagagaactcagaaataaggtcgcatacctacaactgtctgatctttaacaaagctgacaaaaaaaatggggaaaggacaccctatttaataaatggtgttgggataactggctagccctacgcagaagattgaaactggaccccttccttacacaatatacaaaaattaactcaagatggactaaagacttaaatgtaaaactcaacactataaaaaccgtggaagacaacctaggcaataccattttgtgcataggaacttgtaaagatttcatgataaaaacaccaaaagcaactgcaacaaaagaaaataaaaatgacaaacagtatctaagtaaacttaagagtttctgcatagcaaaataaaatattaacagagtaaacaaacatactaaagaatgggagaaaatttttgcaaactatgcatctgacaaaggtctaatatctagcatctacaaggaactaaaacacattttcaagaaaaaaaacattaaaaagtgagcaaaggtcatgaacagacacttttcaaaggaagtcatacatgcaaccaacaatcacatgaaaaaaagctcaacataactgatcattagatgtagatgatgggttgatgggtgcagcaaaccatcacagcacgtatatacctacgtaacaaaccggcatgttcttcacatgtgtcccagaacttgaagtataataaaaaagttaattaattaaaaaaagaaaaatgtaaatcaaaaccacaatgagataccatctcacaccagagtggctgttcttaaaaagtcaaaaaattaccgatgttgatgaagtcgtggaggaaaggaaacacttgtacactctaagagtgtaaattagttcaatcaagaccagactaaatatagatatgcatccagaaatgcttttagaaaatatatcatatgtttataatacataagctaataaaatgggagagttctctgattcccctggcaggatgtgtgacaggggtgtggctcacctgtttggtcacccggcagctcaaacccctaaggcagatgggcaggtgcagaggccaggcaggtgcagaggccagggcagagcgttttggactctcagccccatggcagcgtctagggctgggtgcctacaaccacagtgttactaagctctgtcagctttgccatctgcaggcggcttgtgtgttagttagcccaataaaccctctgccttatctcaagggcagaaggccagtgtgacagtcttatgtatcctgagttcttgcccagtgtcccaaaagaatcggatcacacgtgagcgtgaaggattgaatgcaaggttttgttgttgttgttgttgttgttgttttctttcgttttgtttttgttttttagagacggagcctcactctgtagcccaagctggagtgcagtggcgccgtcttggctcactgcaaccttcacctctggggctcaagagtgaatgcaaggttttattgagtggtgcaggtggctctcagcgagatggataggtagcagaaggagggatagactgggaaggtggtcttcccctgcagtcgggctgcccagaggcaggactctgctctgaccgccgccagctccccaccaccccacctctccgctgaactatcctaagcatctagagaggtccctcctcttctctatttctctgccacatcgttctgccgttgctagtctgcttgtcggctggtcgtctggccttgatgttcagctgcttgtgtgtgtgcctgctaaggtctcaggtttatgtgggcacagaatggggggcgtggtaagccagagaggtcttggaaaatgcaacattcaggctcaaaaacaggagtgcctgttctcaattaggtctgtgggcacatgcccgagggtgaatccctcaccagtgaccttgctcttctctaccccacacttcgctgcccaatctccagttccactaatatatctaaaagtcacatgggatccctccagtctagattattggtgagactactgaaagcttcaggtacaactttaacatctgcttaccttgtttttttttctcttaaacagctttagtaatgtataattgatgtactataaattctacctatttaaagtgtacagttgataagttttgacatgtaaacattcatgaaaccattactacaatcaagataataatagatcaattgccgcaacagttttatcatgttcctttgtaattgtcttatacttctccccagtctcctatagccaggtaaccattcatctgttttctgttaatagagctttgcttgcatgttatagagtttcatataaatggaaccacagtctgtatacttgtttcactagcatctttcactcagcatcattatttttattttgagatttatttactcttcatgtaccaatggttcattccttcatagtgcggagaaatacctcattgtatagatatgctacaatttttttattcattctctgttgatggacatttaaattgtttccaatttgaggtcattgcaaataaaattacgatgaacatttgtgtaaaatctttaaatggatatgtgttttcatttctcttggctaaatacctagaagtaaattggctagatcacagggtaagtggatgtttaactttttaggaaactatcaaactgttttccaaactgattttaccattttatttccaccagcagcgatggagagttctggttgctttatattcttgccaacatttgatatgacctgtctctttaatttcagcctttctaatatgtgcatagtacttcattctggttttagattgcctttccctaataactaataataataagcatcttttcatgtatttactgaccatctgtatcttctttggtgacatgtcttatccaacattttaattactttgttttattatttatcgagttttaagagttatttatatgtgttctatgtatcttttagcagatatatgttttgtaaaatattttttatttcaatagctttcggggtacaagtggtttttggttatatgtattaattgtatattagttaattctgagattttattgcaaccatcacccaagtagtgcatgttgaacccaataggtagtatttatcccacaccccattcctaccctctcctttctgagtctctaaagcccattatattactttatatacctttccgtactcacagcttagctctcacttacaagcgagaacatacgttgtttggctttccattcctgagtgatttcacttggaataatggcctccagctccatttaagttgccgcaaaagacattattttgttccttctcatggctgagtagtatttaatgatttatatatacacctcattttatttatctactctttggtcagtgtagacttaggttagttccatatctttacaattgttaattggattgcaataaacatatgtgtgcatgttttttttttcttcatataatgactctttttttggtggggggatagatacacagtaatggcattgctgtattgaatggtagatctacttttcatttctttttttttgagatggagttttgttcttattgcccaggctgaggtgcagtggcgtgatctcggatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctgaagttgttctgcttacttttgagtaatatcggtagctgacattttctgagtactgactgtgcccaatctgctctgtgtgctgcctatattttacctcacttaattcttatcacagtcttataagggatttttttttttttttttgagacagagtatgccctatgtggcccaggctggagtgcagtggtgcgatcttggctcactgcaacctctgtttcctgggttcaagcaattctccttcctcagcctcccgagtagctaggactataggcaagcaccaccatgcctggctaatttttgtatttttagtaaagatgggtttttgccatgttggccaggctggtctcgaactcctgacctcaagtgatctgcccacctcagcctcccaaagtgctggaattacaggcatgagccacagcgcctgacttgttatctttattaggaacaaagtttcttctgagtaaacatttagtctttttgttgttgttgttgttgttgttgttgagacagggtctcgctctgttgtctaggctggagtgcagtggcatgatatcggctcactacaatctcctcctcctgggttcaagcattcttctgcctcatcctcccaagtagctgagattacaggtgcgcggcaccatgcctggctaattttttgttgttttagtagagatggggtttcactatgttggccaggctggtctcaaactcctggccttaagtgatccgcctacctcggcctcccaaggtggtgggattacagttgtgagccatcacgccggcttcttggtggcatcttgatacagggtgtgctggatatctgtggccaccctgatcaattttccaccttgctctattccttaagaatctcattcatagggactacacaataatcgtttatcttctctcagttttggttgagttcaggcatttgaagataggaagaaagtaagggttttgaactatttattttcatggctccctctatgtagggttaacatagggtagctctgtctctctatctatgacctcaattccttttcaaccctatctatacatctattctatctgggctctagtaactctgccttccacttgcccatccaggcccagggtagtgctatggaatgaactcccatccacccccaaattcatatgttgaagccctattccccaatatgactatattcgaaaataagaccttaaggaggttattaaacttaaatgagttcataagggtgtggtcctgatccagttgggttaatgtacttattaaaagagacaccagagagcttgctttctcttctcattcaggcaccaaggaagggccatgtgaggacaaagcagctgtctgtaagccaggaagggagccctcaccagatattgtaccctgttagaacgaaccttgatcttggactgtccagtctctaaaactgtaagaaaattaacttctgttgtttaagccatccagtctgtggtattttgttatggaagcccaggctgactaattgggatagtaaggcactatcttgtatagtttcttaacactctgcccgcacttttgtaaagagtccctttattaaactccccctaattggcattcatgctgttttctgataggatcctgattcatacaaagcagacaatcagagaacattacccaagctaagaagagtgactgacccaaatgttctccttctctcctggaacttgaaggcataataagagtgcatcttatttctcttggtagttaggcttcagtttctgtttctgttttgaagtgtatgagactgctgtaactcatgctctgttcttttggcccagccaatgtatggcagtttcttataaggatcacaacccaccatctcctcaggctgaccagattcttcacttcagctcttgctggtactgtggatttttcaagactcacttatgtgcatactccatttgaccctagcactggcctttgcagtggtgactccttggagaaaaactcactcagtccatggttaacttgcacacacctccagagttacatgggcatttctagttctcttcacatcttgggaaaccaagagacaatctcctaggctccccctgcttaaacatgctacttaaccattttaactctactgtggccttcacattggctctaggcactctgcttccaaaattccaaacaggaagtggggtgcaaatcctatgtactttcacttaatgtctctgtagacattcagaagcacatttccacccaatttccctctgaccctcttcttggacaaagtttttgtgataccactttgatgataaagaatctagtgaggccttaagatacaacctaagaaagaaggtcaaaaactgcaaagtagaaagaacatttagatttctacaacttttgcaatttcttgtgtatgtgacgtttgtctccttataccacagagattaccaaaacaggcaccagaggaaaaaaaagatgatcaccaccaccaccaccaccatttaataaataatgtgtttagcataacttcaggatgagaaaagaagattagagctggtgggacagtgattctaagacttctcagaggtgatttccaggatgactactccaaagagaagaggcaagtaaactgcagtcctcaggacctgttgctaagaagaaaagaaattctgaagaatcaattcagatctgaaaatattggactgggtcgaaacacacttgaaaatataatctgtcatacattttctcattgcttaggagtatgggcttgggcataaataagattagcattttagcaaacatttactgcttagaagctatgtgaacgtggagaagtgtaacacagaggtgaagagccctggctccagagttagggatgtggcttgaatcctcgctctgctacccagagcaaattatttacttctttgagcaaattatttacttctttgaacctcattttgttttctttaactaggatagctaatccaatagttttttcttcatcaagtcatatgtgaagtacttatcactaacctgttgtgtgtatgcatgttagtgctaagtacttcagcaattgatcatcattattatcaacctgagaaaactcactttattcttgtcaaaggaaaataaatctcaggacccaaaaatcactaagccaaagggaagtcaagctgggaactgcaatgggcacacctgcctcccattctattcctaaataagatagctacaaaaattaaaaagctacatgcttcccttgcagttttcccataaggaaattccttgtgaacaagagacagaactcagagtcatccctgtgctcacgtgagtcagagtccagcctgggcagcatagtgaggccctgtctcgacaaaaatttaaaaacttagctgagtgtgattgtgtggttggctcatgcctgtagttccaattacttgggaggctgaggtgggaggattgcttgagccaggttgctcaatgctgcagtgaggtatgacactgccactgcatgtcagcctggaagacagagtcagatcctatctctggaaaaaaaaaatgcttgtagaatgtaaacatgaggccctgtctctacaaaaagttgcttgggtgtggttgagcccaggagtttgaggttgcagtgagcaatgattgcaccattgcattccagcctggataacagagtaagatactgtttgaaacaggaaaaagaaacaaaaacaacatttgtatgtgggtatgttttatttccggggggctgctataacaaagtattatagattgtgtcttcatattttggaaggggaaaacaagctcattggggccgcttttttaagggcactaatcccatttatgagggctcttctgtcacgatccaatcaccatccaaaggcccaacctcttaataccaacaccttggggcttagaatttcaacaaacggattttggaggcaggggacataaatgttctgatagcagggctttttagaagtgtcatgaataattaaattctaatcatggtagccaagccatgtatcagctttcttataacttaattagaatgccaaatactgtggaagaaacaataacattgcaagcaaatgtgttattgttactttgaaggaagttatcttctagtatagtagaagtagtagatattgtagtggggtaaaacgtgttttctgacaatgactccttttaccagtagtgaactggtaaatgtttaacaaccagctctccagaaaaacaaaataaaacaaaacttatttgtaatgtttgtcaatttatgtggtgtaattactcctaccatgaccaatttcaaactatctatgtgacatctcatcactgaacacaggaagaaatgagaagtaacaaaattttatagtattttcaccatacaggtgcaataattgtaaatataaataacctcaagaacaaataatattaagttataattgaaagaatcaggaagtggtgaattttgaatatttattacttttgtatttaatatagtttacttaactatacttaatattattaactttgtataatttattttttaataatccctatgtttaacaaccagtctacaaaaattttaaaaatttaacaactggctcttataagtcattacaggcaagcttcagcacaccattatgcttaactgcccctcagatacacagcactcatagctatatatgtatgattttataggatatcctggccacagctgatgagagtaaatagggatgggaataggttcaatgtcacttctcccagaatttggaaagggaatcagactggaaatcatcctgtttgtgtggctgaaactataactcatgaaaatttgaagttacaggcagtcactttttgaccattatgtggacttagtagtaaataagatttatcttccagtatagaagcataaaaatatgcaaagggaaaccagaaatggggaaacacatctcatttgtcttaaagcattctagatttcagcggcagttcttgagacctggttgcattctacccttcgatttggacagatacatttaccctcacagtagttttccttttcctctaatataactcgaattgctttttgttatttgcaaacaaaaagatggacatgaaggaaaaaggaaatagcaaaatacgcaaaataataagcgtagtataatactgggtgaaaaatgttcaattgctctatagctcatagatcaaaatagagaactttgccctaactctattcgtagataatgaacattaggataaatatttcaactctcctttttgagaaaaccacaatctaaatacagctacctttctctgtagattctactgtaatgtgtgcttggatttaactgcctctcattgtaaacaagattgttttgaggcagctgaaaggtaaagagctttcctttggcaagctcaacaactcttgtgacttaatcatcatctatacaagaatgattacttcagtcagacttctcacctgatgtcagttgtttccttgacatcttttcttagatgtctcatgattagctcaattttaaaaagctcaacagtacccccttgatccaccactacccacactgtccactaacctactcatgctagggatctgggaattagccttctcctcacctcacatctccagcacttgcagtacagtgaggaagtgagggtgaaggggaaagggagctaaggtacagacaatggctaatttacatctcttggtggcaagtgttacaacaggaatagtatacaacactatagagacatacaatgggaataaatccatgagttagtcatatgctcctttctagaccgttctctgggtactcactgcctgaaaaacatgattttttcttacaggtttcagctaattctgcatctcaccaagaaatttttccttgacaacctctccctaacagaattagttgtctctgttgtgttcctgtaaccgagtatccccatttttcttaagaaaaagggaatgaataactattattattttctcttctctttttccttttccccttgatatggtttggctctgtgtccccacccaaatctcatctgaaattgtaatccttccccatgtgtcaaggaagggacctggccatggggcgataggatcatgggggcagtttccctcatggtgttctcaaaagatctgagttctcaaaagtgagaagtgagttctcaaaagatctgacagtttaaaggtgtgtggcagttcccccttcattctctcctgtcaccttgtgagaaggtgcttgcctctccttcaccctttaccatgattataagtttcctgaggcctcctcagccatgtggaactgtgaagcaattaaaccttttttaaataaatgagccagtctcgagtagttcttcatagcagtttaacaatggactaatacagagaattggtactggagtttgaggcactgctataaagatacttgaaaatgcagaagtgactttggaactggataatgggcagaggttggaacagtctggcgtgctcagaagaagacagaaagacatgggaacaagtttggaacttcttagagtctagttgagtgattttgaccaaaatgctgatattgatatggacaatgaagttcaggctgagatggtctcagatggagataaggaacttattgggaactggagtaaaggtcactcttgatatgctttactccagagactggcagcattttgcccctgccctggagatctgtggaactttgaacttgagagagatgatttaggttatctggaagaataaatttcctttttttttgagacagagtctcgctctgtcacccaggctggagtgcagtggcatgatctcggctcactgcaagctccgcctcccaggttcacaccattctcctgcctcagcctcccaagtagctgagactacaggcacccaccaccacacccagctacttttctgtatttgtttagtagagacggggtttcaccatgttggccaggatggtctcaatctcctgacctcgtgatctgcctgcctcagcctctgaaagtgctgggattactggcatgagccaccatgctcagcctataaatttctaagaagcaaagcattcaaagtgggatctggctttttctaaaagcctgcagtcatatgcattcacaaagagatgatctgaaattggaacttaggtttaaaagagaagtagagtgtaaaggtttggaaaagttgcagcctgaccatgtggtggaaaaggaaaacctgtttttgggggagaaattcaagtcagctgcagaaatctgcaaaagtaaagagaagccaaatgttaatagccaagacaatggggaaaacctctccagggtgtttcaaagttcttcacagcagtccctcccatcacagactcagaggccaaggaggaaaaaatggtttcgtgggccaggcccagggcccccctgctttgtacagctttgggacacggttccctgtgtcccagctgctccagtgccagccatggccaatggaggacaaggtacagcttagttcattgcttcagagggtgcaatccccaagccttgatggcttccacatggtgttaagcctgcaggtgtgcagaagacaagagttgagctttgggaacctccaactagatttcagaggatgtatggaaacgcctggatgtccagggagaagtcagctgcaggggcagagccctcatgcagagctcatactagggcaatgcagaggagaactgtggggtggagcccccacacagaacctccactggggcaccacctcatgcagctgtgagaagaggactactgtcctccagattcccaaatggaagattcactgacagcttgcactgtgtgcctagaaaaactgcaggcactcaatgtcaggacttaatgccacccaatgaaagcagctgcagtggctgtaccctgcccagagccacaagggcagagctgcctaaggtcttgggagcccaccccttgcatcagcatgacctggacgtgaggcatggagtcaaaagagattattttggagctctaacacttaatgactgccctattgagtttctgatttgcacgggggcctgtagcccctttgttttggccaatttttcccgtttgaaatgggaccatttacccaatacctgtaaccccatcatacactggaagttattaacttgcttttgattttacaggctcataagcagaacggacttgccttgtctcagttgagattttggacctggacttttgggttaatgctagaatgagttaagactttggggtactgttggaaaggcatgattgtgttttgaaatgtgagaaggatatgagctttgggcggggctgggatggaatgatgtgatttggctttgcatcccaacccaactctcatcttgaattgtaatccctgcatgtcaagggagggacctggtgggaggtgattggatcataggggcagtttcccccattctgttctcatgatagtgactgagttctcaccagatctgatggtttaaaagtgtgtggcagttcccccttcatgctctctctcccgctaccttgtgaagaaggtgcttgcttctctttcaccttccaccatgattgtaagtttcctcagtcttccccagccatgcagaactgtgaatcagttaaacctttttttttaaaataagttacccagtctcaggtagttctttatagcagtgtgaaaatggactgatacacccctgttctccactttctacttagtcttttagtaatgacaatatagccttttaccatccccttcaccagacgctccctacagggtaagttcatctatgcactctaagacggaactctctttgagagttaacagtcgatttatagaccaaagcatgcctgctatggaactctcacccaccagagggttacctcaagagataacaattgaaaaacatgtccgctactgtctcccagctagggagtttttatcatagtcctgcccacaaaaatgccagaagtcaccagcttgacctcctggtatgtaagggaccaagctaacatgcagacccctcaccttgctcacttcctctcctgccttttaaaagtgcctgctttaggttctcactcataagtaggagttgaagaatgaaaacacatggacacagggaggggaacaacacacaccatggcctgttgggaagttggggatgaggggaaggaacttagaggatgggtccgtaggtgcagcaaaccaccatggcacacatatacctatgtagcaaacctgcacgttctgtacatgtatcccagaacttaaagtaaaataaaaaaataaaaaaataaaaagaaaaaagaaaatgaaaaaacaaaaaaaggaaaaagaaagtaagtgcctgcttttgctccagaaacaaagtagtacatttaaagtcaagactcctgtgcttcttcccctaagctagcttgggaaataaatcactttgtttataccagacctcgcttttgttaattgggctctgcaagcattgagtgactaacctgcatttattagttacattctcactgcatttgtacttgtctccattacaacaattataattatagatacattttaagttactatggagccccagcagaatgcctgtcacatcaaaattatcaaagaagtatttagtaaagagaagaaaaaaaagaataaacagaagatatcaacagctctggattctaccagtgaccagcattcaatcaactctatataaattattctctctgttcctatattttctcctttgtccagtaagaaattggactcatggccagatgcagtggctcatgcctgtaatcccagcactttgggaggctcagtggggtggatcacttgagcccaggtgttctgagaccagcctgggcaaaatggggaaaccccattgtgggggttcagtcaggctggtgggaaaaattttagttatcatagccacaaaccctcttggaaggcctgagagtttgcataacttcagtaatagatctagctgaaggcagcctagtccctttacctttagttaaataggttaaagtagatacaaaggaatgtgggggagtttatctaactagcttgtttactcatgtggtcctaagactaatcttagtgtgcttaattgctttctactcgggaggtccgcaatgtcaattaccctctagtggtgttgactcaagcctttgtcaattaatctttactgaatgaatgtgagtcttgctgtgtctaggctggaggttccaactatttacagcactcttcttggtgtctgtaagtggcctggatgctcagccagactggcaaagcagaatatctgtgtcagtgcacgttattcatctgtcattgggtcagggtctgcaggacagacccctgcaccccatctctacaaaaaacaccccctgcaaaattgtctgggcatggtgccacatgcctgtagtcccagctacttgggagactgaagcgggaggattccctgagtccaggaggtggaggctgatataagccaggatcatatcattgcacttcagcctaggcaatagaatgagaccctgtctaaaaagaattaaaaaaaaaaaaaaaggaaagaaaggaaaaaaagaaaaacgatatggagcttgaactttccttgactttgggcacgtcacatggcttcgatttcttcatctataaaatgtcaaccacagagttattgtgaagatcaaatgagctgtgcatgtgaaatgaaactacctttacaagcattaaatgctataaaaattttaagcatggcttttagtagttttagctctaattttctattattctaaatagtggaatgtggtagaagtatatcactgttttttctttttttctttttaaccagtggtggggataaggggaaggaagtggttgaaaaatcgaaagggaacttcttacttgggtaagtctggacttaattgtgccaaactttctaaagcagcttccaggacaaatttccaggaatatttaaaaaattgtttagactgactggaacacagatatgaagccacattttttgtgcacgtgtgactatgtgtgcctctggaagatttcaacacaaacacgctctcatctaaattaacgctttcctctgaattgactcatttgaccagcataaccagtttgcatgccagtgcaagcagagaaagttgtaataaaaagaagaaaagaatgaaaggcatttagaaattcggtggttaaatgtacacttagttaatcattgtatttgtttttcaagggcttcctaaccttttggagaaagaaaaatatggcagaaagctgactgaagtttgaaattaatatgtgcaaaatgtctgtagaggatctagtctatcctcctttccttcatcttaagacttaattttatccaaaaattaagtagcctgattagtcatccttgctttcttctcttcctggctccttgggttttttcccatatgtatttgttcagcatctattacaaagcaggcactgcccaaggcattgtttttaatgtacaagtagggagtttgaaattcatcctttcgatcagaagttctcaaactatacggtgtatatgattcacaaggaaaatttgtccaaaatgcagatttctagtcttaatcccagatatcagatttgaggctcttcgtggggcctggcaatctgccattttaacaagtgtctgggagagctgtggctcatgcctattatgccagcactttggaaggacgatgcaagaggattgattggaatttgtgaccagcctaggcaacactgcatgactctgtctccacaaaaatttaaaaaattagccaggtgtggtgttgcatgactgtagtcccagctatttgggaggctgaggtgggaggatggagtgagctgtgatcgtgccactgcactccagcctgcgagacagaggtgagaccttgcctcaagagacaacaacagggccaaacgcggtggctcacgcctgcaatcccagcactttgggaggctgaggcaggcggatcacctgaagttgggagtttgagaccagcctgaccaacatggagaaaccccatctttactaaaaaatacaaaattagccaggcatggtggtgcgtgcctgtagtcccaggtgagacaggagaatcgcttgaacccgggaggtggaggttgcagtgagcgaagatggcaccactgcactccagcctgggcaacaagagagaaactctgtctcaaaaaaaaaaaaaaaagacaacaacaatggccgggttcagtggctcacgcgtgtaatcccagcactttgggaagccaaggagaatggattatctgaggtcaggagttcgagaccagactggccaacatggtgaaaccctgtctctactaaaaatacaaaaattagtcaggcatggtggcagacacctataatcccagctattcagtagggtaaggcaggagaatggcctgaacccaggaggcatagtttgcagtgagccgagatcgcaccactgcactccagcctgggtaacagatggagattccatctcaaaaaaaaaaaaaaaaaagacaacaacaaacaagtgataagcaattcaagggactccattcacctgtttgaaattaataaaacacttagtgattagattaggttggtgggcagctgaactcttcaagattttatctatatctctttaagaactccagaatcggggctctctgttcgaatccagactctgccacttaggagctattcagttgattgtattaatcaagttaacctctttgtactctgtgtcctcctctgtgacagtacatgggaatcaaaatatctacctcagagagtcactgggcagatttagcagataaagcatgggtgttatctggcatatagcagtaagtacaaaaaagtagctacaataataataacataacatataaattaatataataacattgttaccattattggcagtagttttactgtggctctattttttagagagaagagagaagacacaaagttttgcccacaataagtggtcaggtcttggaatatgactagatgattgcttcaaaagagagaagtgttctgactgcttgtatatgtcttctgaggcggaaattgctgttagtaacaaccattttagtttacattttctaaatattattaaatccctgagtagtaggtaatattattgctattctgacattttcttctcatggcttaatttaaaagaatcaaaattatacccagctcagagaggtaaataacaaatgttctcaagaagcatctaaggccaggtgcagtggctcacgcctgtaatcccagcactttgggaggccgaggcaggtggatcacgaggtccggagttcaagaccagcctgaacaatacagtgaaaccgcgtctctactaaaaatacaaaaattatctgggcgtggtggtgggagcctataatcccagctactagggaggctgaggcagggaactccttgaaccctggacgtgcaggttgcagtgagctgagatcgtgccactgcactccagcctggacgacagagtgagactccgtctcaaaaaaaaaaaaaaaaagcatctaaaacaggggtccccaacccccatgacacagattctggtccatggtctttaggaactgggttgcatagtaggaggtgaccagcaggcaagcaagtgagcattaccacctgagcaccacctcctgttggattagtggtggcattagattctcataggatcgtgaaccccattgcaaatcgtgcatgtgaaggagctacattgtaagctcctgatgagagtctaactaatgcctgatgatctgaggtggaatagtttcatctggaaaccattcatctctcttgtccatggaaaaattgttttccattaaactggtccctggtgccaaaaaggctggggactgctgatctaaaagatgtcctcatcataatcacagataatgaatacagaatactcagtatcggaggaaagataaaaagttcagtttgggtcaatttcttcactatttacatacacttagggccttagacccttccatgctaaaatttaaatgcatgcattagctcatttaatctataatagccctataagtaaattgctattataatccttatttatttatttatacatttttttgagatggagtctcgctctgttgcccaggctggagtgcagtggcataatcttggctcactgcaaccttcacttcccaggttcaagcgactctcctgcctcagcactccctgggactacaggtgtgcaccaccacaccacactaatttttaaaatattttttagtagagatggggtttcaccatgttggccaggttggccttgaactcctgaactcaggtgatcagcccaccttgacctcccagagtgctgggattacaggcgtgagccactgcgcctggcctataatctcattttaaaagatgccattataaaacatctttaaaaatgaaatttattctctgaagtgtcaacataataagaaagaaaaaaaagacacttaggttaactaaagtaataaaggaactcaaacttgaaccaagagctatgtgatcttacatctcactttagtctgcatatcaaaccgcctcctagacactttgaggctcacgggtctgaagtgggtgtagtggcatcctgggaagatttaataggacaacaaaggtaagtcacacaatgagctctaaattctagtctgtccaaagcatgctcctttctaaaattatattctaaaatgttaagaaaaaatacaaaaaagggcattttcagaaaatgttttatagtccttcctctgaatgactaactttaccttttttctacattgcatattctttatcccaaacatatgcagaacatgttgatgtgttctctgattacaaagtgttttcaaatgataatgtaatgactcagtagacttgtgaaatgcaggcagaaaaaaatcatttaaaaccaaaattgactgtgctgcttctacctgctaagggaagtggtctaattcgcatcagaggggtaagaggcagagttcccttccccttttgtaaaagaaaaatggggacagcaagcaaaaaatcactcaattgttaggaaaaaatatctaagccaccctctcaccttccttctctttcccaagaattggttgcactactgaaaccagaggagtgcaggaattccactattttgtaaaataagtttgagccaaatttgcctgaatttctaagacaggctactttggttgatacacggattaagcctaaaaataaaaccttttgagataaattgggtagtacacccacagaatcgcgcccgagtcaaggagggaaatccttttggtattgtgtttaaaaatcatttttaattttccctacaacgaagcgaaactcctcacatgtgtttaattgttcgctctgaaagactacacaggccgttacgaaaatagtttttggcatgagtagtgatctagttataaatcagtgaaaaataaattgtgtccataaaaaagttacagaatttacccctgtgccattaaatattagttaacaaccttgatttttaaattgatgtgccatattctaccatatcgatactgtatttgatatggttcagttgcagactgctcttccagaataaataggcagaaaggaatttatcactggctgcaaaccattagatggcttacaaactgtttggaattgtaggggcaggcgctgtgtgagcgtttaggaacaacttccattctccagaaatggcatgggtagtcctgcgatccaaaggcagcagtgtcaggtggaagcgctagaagcccgaggctgccattggcagaacaaagcagtctcggcctggcttggcagcatccaaaaggaccgcagccgccctgccgctgcacacggtgcatctgattggcggaacccaaacccttccgcagccctccctgcgaagatatctgggaaacgtagtttttaccttctaacctctaaggcacggaaagcttattcgatgttgattgtaatggaaatagaactatgtattaggatttgtttaaccatcccttgagttttaaattttttggttgttacgtaattttctctgtaataaataaataaaattccctaaacaatatgaatacttttcaaatttttgataatgattgcaaaattgctctcttgaaaagttatgccagtttatactccttccagcaatctttgttccatattgtcagtcatgattaatacatttgtcaatgcttttgaaaaggaaagtgacatattatttaaaaactatgaatttctttggctagtttgaagattttaattctcaccacaagtgaattacgattagatttttttttttttttttttgagatggagtctcactctatcacccaggctggagtgcagtggccaatctctgctcaccagcaacctccgcctcccgggttcaagagattctcgtgcctcagcctccagagtagctgggatttgaggcatacgccaccacactaggctaatttttgtatttttagtagagatggggtttttgtcctattggccaggctggtctcgaactcccgacctcaggtgattctctggcctcggcctcccaaattgctgggattataggggttagccctcgcgcacggccgcaattaagtctttagacgatctgtttccccagtatttcccagcaatgtatttatgaatcatctcgcatctcgcatggtgagaaacttaacatgaacgttcaaccatgtaaaattattaccagtgaaataaataacttaatgtctagtgacctcttactgtagctctgtattggtagatagacacttcttttttgatctttcaagtatatagtaaaaaaaatgttccttttacagttttcaatttttttttttttttttttttttgagatggagtctcgatctgtctcccaggctggagcgcagtggcctgatctcggctcactgcaacatccgcctccccggttgaagcgattctcctgcctcggcttcccaaggagctgggattacaggcatgcatcaccacgcctggctaatttttgtattttctttaaattagagacagggtttcaccatgttggccaggctattctcgaactcctgacctcaagtgatctgcccgcctcagactcccagagtgctgggattacaggtgtgagccaccgcgcctggctaatttttcatgtttttagtagagacggggtttctccatgttggccaagctggtctcaaactactgacctcaagtgatccacccgccttggcctcccaaagtgctgggattacaggcgtaagccatcgcgccctgccttgttttcaaaattaaacttagttgaagcctgtaagacttaaaatgaaagcaagattatgtgacttgattatgatgcagccaaatgaatttagatgcaaatgctagacttgaaatgtaagtgtacgaatatacagcagtataattttatgaggtctgggggttacttgtgcatgagcccaggatttagatatctggctactcacagtaagatccatggaaggaaataaattctataaggaagcactgtataactcaaagaaactagagaggcccaaatgtccaaagctgccatttcgcttgctggaatttgctggtggaataactacccttccccgaattaatgaggctaaatgaattcctggggaaccctcaggctgtcagtgtaacacctcccacatcttttttctccagcaggtggcatgtacagcaccatcctgaaatggtgataactttattattattattgtcactattcatggggctaaccatcttcccttttcttcccaaataagtacatggagttttagcataggtattaaagaaggctcgtcagcatgatggcttaagtctgtaatcccagctactggggaggctgaggtgggaaccgaggagttcaaggctacagtgagctatgatcatgccactgcactatagcctgagtgacagaaggagaccccgtctgtaaaaacaatttaaagagagaaagagaaagatagagagagagaggattcttgtttcaatgacctagaggaaaaaagatgttataagttcgcttttgaaactggaacattaatttttcaccatattaagacaagaccctgtatatacacgttaaacttaaacagctatcttttaggctgttgaatgcaagaaggtaagtttaagtaccatctagtggtaggcatcaccctccacctagtggcatccctctccatctagtggcaagataggcgaattgaaagcaagtgccaaagaagaaatagtctgatactgaaatgttgagcaaaagtttaaaaagacaacagtattgaccacgcctcctccaagtcccagcgagcccgtgtacaacctgtcccgactccagccgcctcttcagctcgccatggatcccaactgctcctgtgccgccagtgactcctgcacctgcgccggctcctgcaagtgcaaagagtgcaaatgcacctcctgcaagaaaagctgctgctcctgctgtcctgtgggctgtgccaagtgtgcccagggctgcatctgcaaaggggcgtcggacaagtgcagctgctgtgcctgatgctgggacagccctgcccccagatgtaaataacgcgacctctacaaacctggattttttatgtacaaccctgaccctgacgtttgctacattcctttttctatgaaataatgtgaatgataataaaacagctttgacttgaaaaaaaaaaaaaaaaagagaatagtattaaagtaccagataaactttaccactgttttattaaattttaatataaataaactatgtaaaataattcatgattgtagcaggttatctaatttggaaataaaaagaatactcttgctggatggtaaacagactattcctagcatgaggtcttttcttggaattattttatcttagtccttacctagaaggacttaggaagtgacaaacagtgctaaaaacctgagagaaaagttaagacatagtgacagaattttgcaggacaaaagagtgatattagtacagtctttcttatgttaaaccttttatgatcttgaaaatcttatctttaaatcttaagaagctgttggattatactttaatcattgcagggaaaagatttagaaattatgttgtcaaccagtttagatcaaattgacatcagaattgggtctttaggaggagatttttggtacaataactttgtaatctgaggatactaatcagggtataatagtacacttaattagtatgattagctgatagtctcaagttaggatgacagtcattgagcccatatcaggtagttaacagtgagcatctatctgttctaatatgttcagcattctgttaggattagttggtgtccatgctgtccttgttattaaatcatctgaatatcatccaagaccataagggactgtatgttcacaggaaaaaaataacaaaatcacaaaatgtgaagaatgtatgtattatgaaaagaaggtaggcaaacagatatctttaaaagaggaagctaaaaaaataaaaataaaagaggaagccaaatgaatggatcagatagaaaaaaatgttcaaaagtgtaataattgttttaaaaggactaaaaatatttttagagacccaaaggaggaaattagaaacatgaatcagaaaaatcagttatgaaggaccaactggagatattcagtatgaaaaacctaataactgaaataactcagtaagtatggtattagataaaccttatagatgttttttagatactgcttttcagagtgaacacacttgaaatacaaattagtgagctgaaagatcaggtcaatcaactcttctagaaggactcaggaaggacaaagcagtgctaaaaaactgagagaaaaggtaagatacagtgacagaattttgcaggacgaaagagtgatattagtacagtctttcttcagtatcttcaaggattggttcaaggacccactgccttcatagtaaaatccaggaatgctcaattcccttatataaaatggcctgtttgctcataatctacatacatcctcctgtatacattcaattatctctatattacatatgatacctaatacaataggaatgctatgtaaatagttgttatgctgctttggtttttatttgtatttttttaattgttaatttggttttttcttgaatattttcggtcccaggttgtttgaatctgtaaatgcagaacctcaagatacatagggctgagtgtatttgatagaaagaggacagagaaattgttgaaataagagaaatttgaagctaggatgctatatccaattaattcaatgtaaggctgaaataagttattgtaaggtacacaaggcctcagaaggctgacaaaaattctgtttgaaaacactttgggaggatgtgctcaagtaagacaaggaatcaatccagaagttaaccaagagatgtgaaaagtgtggaacaagtgaagctttgtaacgtgtttagataaaaaactgccagaggcatctttaatataaacagcttcaggaagagagacacactgtattgctttctttatcccagagattttggagcgtatacataggtgtcatgcatgtcgtatgtatatgtgcgtatttgttggaggaacaaagcccaacccccacccccgacaaaatcccatgagtttatttacacattgtacatgagaatttgcgctatttcctatcttcagacatgatatttaaaatatataacaattagtacaacatagggcactgaccaatcagaatagacaccagccaaactgctagagcagcttcctggatgctgtgcccttcatgtccggattatgagtacacctctggtgggctggggcagaggcatggggcaggggctcaaagtggcttctatttaccatgtatataggattgtttcaatattttaacaacttgtatggtcatgtatactgactgaatagcaactctgctatgagacataagacatgtttgatgacttcatgcaattttctgaaacatgctctttttttttttaaataaaccttgggcagatgttatgttaagacagtctctgtagtaaaataatttgccatattggagaggcttatcatctttacaatgaaagtcagaaaatataagtaaaacatattaagttgtactaaagcagagagaataatcaaatataatcttactcaagatattttcatgacaactcagcttgcaagatgttttcctaggcttactgggtcataaatattcggtatcattttttttcctatattttaaagaaaaggaatttggaacacgtaaactataaatctaagttttaaaaaatctaaacaacagtttcctctcattgcagacctcattcaaattgcaggctggagccatgcccaatatgcctcttcagagccacaactacccacaggtaggtgggcacttggtgagtgaggataaaaagtttgttgttataagtcattgagttgtgcagttgtttgttacacagcaaatgacattccttttttacttattcatcattcattcaacgtattctaaacatataactatgaactataaaaactcaaaactggcttttcttttaaaagactgactagacaaatttatgttaaaactaatcaggaaaggaatggagatgcaaataaacaacagcacctatgaagtttgcattctactattgaaacagaaaatacacaaataaactgggaatcccaaatggttcataagcaaacgaagagtgacttacccttactctgtaatcagagaactgcaaattaaaacaattggaaagtctgacaatatcatgcagtggtgaggatgttgggaaataagaaacctcccattcaacttaagggaaagtaagctgttgcaaccattccagggagcaacatgaaagtacttggtaaattaactatctttatactttctcaatgatgtagcaattacacttctaggtttcttgcacatgtccctaggaatatttttcacagcaatgtttgtggtagtaagaatggagaaagtctagatgtccattgacagaggaatgggaaataaaataagggatagacacataataaagttatattcagcactcagaaataatgttctagattaatatttatctggatggctcttaaaatatcatgacaaattggggaataaacaatatgagatttataaaagaataactttcaaggatattacatgcatatgcccagaaacaccaaattcatctttaaagatacacatatatctaaatgaatatagcaatgatatactggtagggtataaattaaatatgtaagggtggggtgaggtgagaatggtggatgcatgggaaaaaggtagtaaaaagtagaaaggtaaaatttaaaaaggggtattgcacagacgctgaaaatgtgcaatgaaatgaagggtgtgattaattcaattttgtgacttgatagtctaaaaataactatatgtagtagaatctgaaatatgaggaatagggaactttaagggagtatatggaagtcaacgccgtctaagcatgtgcacactgaattctcacactttcgatgatgtcctgctattatatcttttctaagcttagaggaagataaataccacagtagttatattttaattctagttttatttaggtaaatgataataatgagataagccacaaagttcgaattgacatatctattagtattagtatacataaatgtagaaaatatatttcaaaagaaaaaagaacgtactatgatcatcaaaaacctcacctttccacatgatacatattgttgatattttgatatttttccaccatggaatttattttgcaattaccttgttaatcagtataatgtataatgtgaggattaaattgcatctatggatcttgatgtgttatctttagaacttatttagattgaagctttcattttatctttttcaaactactatattaatgatcttgaatgaagattattataggagttcagtgcctcgcaaaattttcttgtacttaccctgtgcttcatactcttattgtcttgcctcctttgaataatcacaaaagaaaaagaaggcaaaggagtatatagcacaacctattagaggaaatggctgaaatagtattctcttaatgtttaatgtgactattaagagggtattatgctggcatgtaaaacagttaattgtattcagtgtgttttaacatcactgattaattgatggcgtagtgaatgttcatcttggagaaaataccacctttgtatctcaggggatctaaagaatgtcttttgctgctgaataaagtgcttcaaaaagttcaaagggagaaatgtgtatttttttttatggtaaggaagaatagattttaccacttgggaaagtaacagcttatgaaatcacgcagtgatgactgtaattcagctgtcgtctgtttctttcaccttctaaccagtgaaaaaagttaggttacttatttctttgactaagtaaattgaaaaggaataaattcagaaagattatctaaggaaactggttattagagcaaaatggtttgtattcactctgtaaatgaatgctcctgctgcttttctcttcattttaatcataatatttcttttttccagttgcttcatgtgaattttattttattgtttgtttttgtttttgagatggagtctcgctctgttgcccaggatggagtgcagtggtgccatgtcggctcactgcaatctcctcctcccgggttcaagcaattctcctgcttcagcctccccagtagctggaactacaggcatgaggcaccacgactggctaatttttttgtatttttagtagagatggggtttcaccatgttggtcaggctggtctcaaactcctgacctcaaatgatctgcccgccctggcctcccaaagtgctgggattacagcttgagccactgtgcctggccgtgaatttttaaatatatcacatttcaaaataattttgcagttccaaaataattattttgtaattcaaagacagttgaataagcaaatcccttgggatttgattgtgtcagaattataaggtcctgcttatttttatttttatttttggaatttgtctgatggttgcagattattgtcaccggttcctcacgtttgttcccaaaagaagtaggatttgtgagacttggttccacctttgattttgatccatccctctgaatcaggctaagtcacagactccctaggtcattgccacaattttataagtaagacaactaaaaataatctatagtactcactttcaaaagatcaatcactcaattcactgagtgttaataactgatttagctcagggagaaggacatttctcttattattctctataagaaggtaaaatatctaggttcttacatttttgaatagcaaagtaatgttgaaattagatggacaccttgacatgaatctgaataaaaataacatatctcaggaatcttttagtattatattattgatataaaaattattaaaataggctgagcgctgtggcttacgcctgtaatcccagcactttgggaggctgaggtgggcggatcacgaggtctggagatcgagaccatcctggctaataaggtgaaaccctgtctctactaaaaatacaaaaaaaaaaaattagccgggcgtgacggcgggcgcctgtagtcccagctactcgggaggctgaggaaggagaatggcgtgaacctggaaggcggagcttgcagtgagccgagatcgcgccactgcactccagcctgggcaacagagcaagactccatccccccaaaaaaaaaaaaattattaaaatagcaatattattaatgtctacacttggtcttagccaaaaggccaagaagatatagtttcttaaatttctgagatctttctaatttataaaatgctttaatatacagctttatttttattaatttaatttaatttaatttatttattttttagatacagagtcttgctatgttgcccagcctagacttgaactcctgggcccaagtgatccttttgcctcagactcctaaatagctggtactaggcgtgcgcatcactgtaccttacctccatacgcagctttttagaggcagaaactatttcactgacttctatcccttaaacccagaaattgccagacataggttaataagtgcctaaagtaaacttcagtcttttgttgctgtttcccacctcctatatttgaggaattctctgcaatatgtatctttaacagaagctccaaaggccatgtgctctatatcccatctttctcttcaactacagcacagtaacgtaacttaggctcacctgatcagctgtacccagttgaactttcactgggagctggtgatgcaaaagagtagcaatggtggagaatctattctgatagtggcagcagtatagatagcaacaacctgttccagggcagtagtggaaatgaaactagtggtggcatacggtggctggtgcctgaggtgatggctgtacatgtggtggcatccagtgttcagccatggtgggagcagtccccttatgaccctggatctatggttttacttgtggatctggctggtgcatagtgctcattgttgatcttccctttttcaaaacttgtttctttattcttcttgacaattctcttagatatataaaatccttttaataaattctgtttaaattagaattggcttctgtcacttgcattaatatacttgacaaataaaatatgaaactgacttgcatagctctataaccctatcaagacaggttttacgaatactgtttatatatcagtaagcaaagactaagagacagtaatttacttggctaagattaacgtttagtaagaacgaagagccaggaatcatacatagtcactccgattctatgcctgggtctctttcttccctatcacagtgtggcagagatgggttaattttctaagtacacagaaagcttacatttcacaacttctcttttaattctcagcatcatcacttggtgtagagtcccccagagagcaacctgatccatatcacaaacctgagacaaattttggttgccttaagcccttacaatttggagtttattcttatagcagctaatgatctttactccaattaatgcagaaattagtaacaaaattgaggtgctgtcataacaaaaacttaaaatacgtgacattgacagctgttagctggatagtgaggagagagataccagagatctatgttatatggtggtaaaatttttggtaaatttattaccttcttacaagacagaaaatgtacctactgggcttgtcgttttagaggaagagtttgcaaaatcaaatgttggcagagtttgttgggaccgttggcttatttggaaaagtgtagtaataaaagagatgttcccagaagaagattgaccaattgatgaacagaaatgaaagtagagagagaacagaaattcagagcttttcaagttgaatagtcctaactttgaaaccctaaatggtaagaaatggacttacaaaaggctttgaatgaaagaagtccagtacaacttgacactaatagttggataaagggactcacagcaaagatcagattagggtatgccttacacattgtttgctccaaatagactcaaaatacctgccattaagtaaaaagaggaaccacagtggcaaagaagcaacacagatcagactagacaatcatttctaggaataaactattggtatagttactggcacgtggatttgattggaaacaaacagatagaagaatataaaattttgaataaatgattttgccaatggagtcatgaaattgcaataaaaaaacacgtaagatatcagaatttaacacaacctgcatgtcctagaccttcaagcaggtggcaggcagtaggcagtagacttgcacattcatatagctgccaaaaaggtcatgtgccccagttcccactgcagatgcggtcaaggagaataacagacagggggataccttccagagggtgaggacattgcataaaagaactctctccagaaggcataaacagtgcctaatgaagaatttctcctgtccccaaggcaatgtctgcccaatgggattttaaaattgccccaaaccagttgctgtgtttctttttccccttctaaatggaagcgtctattgtggtaattgtaacccttctccaccgttgtaattagatatgtatttattgtctttttagttcataggtctccggagcctggggcatcgcatctagatggaaaggactgaatatcaactgaagagcctaaattttgggctgatgcagtcagtgattaagagttttgggtcagtgatggggcgaatatgtttcatgtgtgggaagataaataaaaggggtgatgcatgaccagaaaggaggactgtggcagaaacagcctagatgctcaccaatcttatttctactgtttgggcagatggaaactgctatagttcaaagcctctcttggagttagattgcaatcatatgaatgagaaatagaatgtgagcgaaactcactggtgtcacttccaaacttggctctttaaatgttcttcacaatcattcatgtactcactctactgtcttatgactattgtacatattcatgcacataatgatgtttccatacatataatgtgtaataatcagatcagggagagtcgcatatctatcagctcaaatgtttatcatttctctgtgttgggaatgttcaatatcttccttctagctatttgaaactatatattattgttaactcctgtcatcctacagtagtatagattattataagttattcctcctatctagctgtaattttatatcctttaacaaatctctccctgtctctcagtaaagtatcctgagatagtggaacttctctggttaacacttggaaaagaattgctgaaaagagccgtctcaccaactttgggctgtgattttgttttgtgaagtcattgtgattttgggatggttgtttatagcagctagcaagtcttagcatggcaaatacagtaactgtcatactaaaaaatatgatgcagaataaattatgttaggtagattaaataaatctatattattaataaataatatttgtaagtctgaattttatctgttggaatgtcagaaaagaatggggattatataaaaaagaattgttagaaaccagagtgtatcctatataggatcattagtgaagaaatagatggaaaagtggaaatgaataactatttcttccacacagaataaaacccagaaacaaagaaaagttaagtagtattagatagtgattcccaagcctgggaatgggagtcagtgatactcacctaggagagaatattaggaaggagtgagtgacatgaaaaaaaagtcacggagggaaagggtaaagttttagtaagtcctatggatgacaattatgtattacctgcagcttgtcctactagaggaatagtctctgtgccaagaggaaaaaaaaaggctcagaatttctgatctaagacataggtaattaagaactcaaaaggaaaaatgtagtcagtgtataagatgatggaaatcttgttttaagagaactgaattattggagaatgtgtaaagaagaaagaggtgttaaacttttgaaggggagtcagatttgctcacatttttaacctttaacagtttcccacttttttttttgaaacggagtttcactcgtgttgcctaggctggagtgcaatggtgcgatctcggctcacagcaacctccacctcccaggttcaagtgattctcctgcctcagcttcccaagtagctgggattacaggcccgtgccaccatacccggctaattttttgtatctttagtagaaacagggtttcaccatgttggccaggctggtctggaactcctggcctcgtgatctgcctgcctcagcctcccaaagtgctgagattacaggcgtgagccacagtgcctggccatactttattctttatgatacaatgtctcactctgttgtccaggctggaatgcagtggcagaatcacaggtcactgcagccttgacctcctgggctaaagtaatcctctaccccagccttccaagtagctgggaccacaggtgtgcaccaccacgcctggctaatttttaaattttttgtaggtatcactatgttgcccaggctggtcttgaactcctgggctcaagcaatcctcccatcttggcttcccaaagtattgggattacaggagtgagccactgtgcctggcctggatgggtaacctttgaaaagttatgtaaaatctgtgtgcctcaatgaggatagtaatagaaacttccctggaattacttgaagtttaaatgagttaatctatgtaaacaacctagaacgggccgggcacagtggctcacgactgtaatcccagcactttaggaggccaaggtgggtggatctcctgaggtcaggagttccagaccagtcaggccaacatggcgaaaccccatctctactaaaaatacaaaaactagctgggggtggtggcacatgcctgtaatccccgctcctcgagaggctaaggcaggagaatagtttgaacacaggaggcagaggttgcagtgagtcgagactgtgccactgcactctagcctgggcagcagagagagactccatctcaaaaaaaaaaaaaaaaaaaaaaaaaaaaaaaaaaaaaaaaaaaaagaacctagaacaatggctggcatagaggcatagaataagcattatatgtattagctatgattacaaaagaggaatctataaggtattctgcagacaaagagaaggaagtggctaatttagtctgcagagtagagaagaaactcagagagctgcaatttgcaaagcaaggaggagagatgaatatttgttttgttttgttttttgagaccaagtttcagtcttgttgcccaggctggaatggaatggcatgatcccggctcactgcaacctctgcctccaggattcaagcgattctcctgcctcagcctcccaagtagctggaattacaggcactcactaccatgcctggctaatttttgtgtttttagtagagacggggttttaccatgttggccaggctggtctcgaactcctgacctcaggtgatccacccgcctcggcctccctaagtgctgggattacaggcatgaaccaccgtgcccagccgagagatgaatattaaaacatatttgagggactttagaaattgtcagtctttaaagtctgtaagaaggatggtctggatgactcctttagcatgaactcattatttagtagatgactccatcccagttagtatttatgcctgtggaaatctcatatgaagagctagatctgatcagcagctctattatatctagcttaatgctcacaatttgttccacaaagccattctctctctctctctgtctttccctccttccattttgttagatcacatattataatagttatatgctttaaacccttatttggaacaataaagatgactgacttacatttcagacattgtcgctccatgtcgctagttttaaaacctgcccaacttagtaataaaaagtaatggctcctcagataagagtttcatgatagtttcttagaaacgagtcaatgacactactgtaatagcaggggaaaagatttctaagtcacatcatattttcaaactgacaattttagctacaaaagtacaacttccaagaggtctttcccaggtaaacatggaagggatttaccagtccacagaaaagtgactgcctctcccttggataaatgagattctttgcttcctgaaaatgagaaactgctatttcaatttcaatgccaaagatcaaattttctgactactgtgaatgaggctgctcagcatttacaacactaaaaacaaagaaaagaaagccgaagaggaacaatttttttttagcatttgccccaggcctttgcaatcaaagcataacccagcttatttttggggtgactacaccctccattctccaggtagttgaatcttccttgcatgtgtgaaagcatcactgacaaagtttcgttgtcatggagtttttagataagtatctctgagtttaaaatcccaaattatatgcatccacccacccttatactataattaatatctgtcttggggctttttagaaataactacacacatcaacagtttcacaactgcttctgtgagtggtgagattagtaggcagatttctaggggaattatgcaggtgaccagtcattaatatgcacattgttaaaatgtttgaacgttgtcatgatgatgatacagcgccgatgagtggaggaacaccaagttcttcgtcctcatgctggtttagataaaacgacactgacacacgtggagtggttttaaggagcggaaagtttaataggcaagaaagaaaagagaaggcagaaggaagaggctctcctgtacagagacagagggaggggggctccaaagccgagagagggaaccccatctggcagggataccagccaggtatatatacagaggctggaggaggcagtgtctgatttgtatagggctcaggggattggtttgacaaagcatgtcattcatatagcccaggaaaaagcctgccctcccaccctagccttttaatatgccaatgcagggcaccatgatgttctacccacgtggggatatgtgggggcggccatgttgccaggaagtgtggggcaaggtcaagatggcagtgggaatagccatgtttgggtggacccagtttctaatggatggcatttgcatatcaaaggttgccagcctggctctaagagctgctttaaaaacgaaaacttcccaaggaccccttttcctctctatctgcctaaaataatttcttaataactcctacaacaatgacaccaaggggccaaattctaagattccaccaacatgatgcagttggcttggcacttcataactcaattaaagggatttttgagggttgttgccttaggtgtacactgcatgctttgaagtttttcctcataaagaacataatgcagtaacttaggagagaccattaaagcatttttccctttaagaactgcagcaataattataatctggtagctactttcttatgttcttgtaagataactagtcatcaacaaatttttttctctattaatttcactgcgatcaaatatttctcaatgaaaataaaagataggaatttcctgtatatatataaactcagttattttgaaacaacacataacattagaattgagaaagaccatggaaatattgatttcagtgtgaatgaaaaagaaaaacttgggaccttaattcactatgccaaaaaagaaaaaaattaagctgaaagatgagtcatgcaagaaactgcctttccttttgttcctaagcagatagctacagataaaagttaaacatctccactgactgctactccatgttcaccttattttatgtaaagtgccgatttactgagcccaagatcaatacttaactgacaattcccctacttgttcattttcctctgcagcttgtggattaccatactctccccttttcccctccagctggcttttcctctttaaatattgaagcctgcaaattcatccttggagaaaggcacagaccacagactgcttctgttattccatgttcatttcttcctggcatgtccttaaccttggcaaaacaaacttctaaatctatttagatcacagaaaggattttttatttctatacttctttaatgtgtttttaaatgtctgcctaatagttcatgcagttgatattccataatctcatcatgattgagtttatttctcagctgtatagaagaggacacaaaggaacagaaaaggcaagtatctcatccaggatttcctagctagtaaaatgaatgcaggaaaaagggaaaggccaagaacagtcacatctatctgtcttttcattttgtttcttcttttgcttttcatgcttagaaattctttctccgcctagagatgagatgaatattcaattatggtttcttccaattgtttctggtgctcatttttatatttatatttaacctaagataatctggaatatattttggtagaacaaataaattagatgtttgttctaagagaagtcttgatgaaatgattaaaaagtttatctataagaattaacagataatacaactgagaaatctttaaaaggaagagtactggaacaggtaacttgtactgacaaaaattgaaactgataatcatcgtaacaattagattagcatgcaccgttttaaggaaaacaagatcaattctatttagcataaaagcagcaattaaaatgatatgaaaatctgtttttctcagacagcatattagtttattaatttagtatttgataattttttcagatacagataatatctaagtgataatttaaaaaaatccaaacatcctaaataaaaatctaagccaaaatctcataacaagcctgtctcttaatgagctgtgacagtgaaataatcctttttacatggtgatagctgatattgtgatagctgtaaacttagctgtcatcacagatcttggctacagaggctgctgtggtaacgagtgaacctaatgggctttgtttacttgagtgaggagttttcttcatgccccaaccctgcctgcttgcaatgtgcatctgaagccaggaggatgtctctccaactgatcgtatatttctttcttgtttttcctttttttttttttttttttgagatggagttttgctcttgttgcccaggctggaatgcaatggcacgatcttggctcactgcagcctctgtctgctgggttcaagcgattctcctacctcagcctcctgagtagctgggattacaggtgcctgccaccacccctggccaattttctgtatttttagtagagacggggtttctccatgttggccagcctggtctcaaactcctggcctcaggtgatccacccttctcagcctcccaaagtgctgggattacaggcatgagccaccgtgcccagccagatcctactatctttctacttttgaattgcaatgtggtttatgtctttggattttaataagcacaaaactcctcctagaattagcaagatatcaaaaaaggcctccaagtggagagcatttggccttgacctcatgtaggaaagaaaggagttggccaggtgtggtggctcctacctgtaatcccagcattttgtgaggcagaggaggatggatcacttgagctcaggagttcgagaccagcctgggcaacacaacaaaaccctgtctccacaaaaagtacaaaaattagatgggcatggtggtgtacgcctgtaatcccagctagtagggtggctgaggcaggtgagttgcttgaacctagaaggcggaggctgcagtgagctgagattgtgccactgcactctggcctgggccacagaatgagacactgtctcaagaaaaaaacaaaacgaaacagggagagtttgaagaacaataattctataattaaagtgtttttagaatagccctcaaggatcctctttctatcttttatactaccaaacctataaacatatatgtggtttccaggatgaggaacacaatacttgagatggaaaactaaagaccggctatgagctccaaggttgaggaacatatttgctgaacccttttccttaaattacatttatagaaataggaaaaatggaatatctccattaggcataatttaaaagcactgaagaagtgtagggatgtgaaaacacttctaaaaaagcaagcttggcaaaataccaacttttctcgaggaaccaatccattctatttttctgtttgtttgtcccaggttcttaagcagcatctgatttctaaactcttacaagggtagtctggataaagcacgttttattttctctgttgaaaactaagtattgcttaaatggagaatcatgccttatttggtagtacgcaaaggtttaaggcattttttttccttagatgagggatatcaatacagaaaagtctgtcactctgttttaaaatttatataagctcaaagtttcaagtgctagttcatgggggaaagaatttgtttattttttgtttttgcattttctatgacatcttttagcataaagccttacagagatcatttttttaaatagtagaaacataaatgcttattgaactgagcactctagccaaggaaaaacttttcattaattttgagataagaggcaaaaatgaaagcatattataaaccttactgattatttcttccttactttggctattggccatcttttagttgaagcatatacatttattaaatgtattaataaatacattaaattaataaagtcccatattaaagaagtttatggaaagatctctccttatgtcttagtgttctcttccaggaagagggtatacagactttatagaaagtagatattccctcttatcttgtaatatatgtccttgtgcagcatgagaagaaaactttaagatcacagactagcctaagaaaaatgatttatctttcagcaaatatttctcatccataatttactttggcttacttctgtgtctacaagtgtctgttgtagcatataaatgaaactagtttcaaacaacttttcaggtgcaataacaaaatgtatgtaccagagcttctggatagctgaacacatgtcagttcctggagggcggtgtgcccagggatggcatggaagctctgtgccccttcccctatgtctcaccctatgcacctcttcatctgtatcttttgtaatatcttttatttactttttttttttagagacaaggtcttgctctgtcacccaggatggagtgaagtggtgcgatctgggctcactacaacctcctcctcccaagttcaagcaattctcctgcctcagcctcccaagtagctgggattaccggcatacaccaccatgcctggccaattattgtatttttaatagaaacggcatttttacagtgttggccaggctggtctcgaactcctgacatcaagctatccgcctgcctcggcctcccaaagtgttgggattacaggcatgagccaccgcacctagcctgcaatatcttttacaataaaccagtagatgtaagcatttccctgagttctgtgggctgttccagcaaattaactgaacccaaaaaaggggtcatgggaactgcaacttgaagcgcggtggtcagaagttccagaggcccagacttgcaactggtttgtgtgtagttggcagtcttggggatggagccctcagtttgtggaatctgactctatctctgggtagataggattggaatggaactaaagaacatccagctggtgtctgccgcttggtgtgttaggaaaaaactccatgcatttggtcatagaattcttcttctgtgttgatgactgttgtgttgtcagaggagagagaaaacacagttagggagagttcccctacacaattgatgtcagtgaaatgggatttgctagaacagccctcactcacagaaacatgtggtttaggaagagaaaggctaaaaggctgggaggatgaggaatctttgattcctgggtgaccatcgtggtcacccatgatatgaagttgcagttgtgttgagatcagttactacaggtgaaagttaccagcggaatttagagatggatagaactccccaggaattggttcactggatgcaaaagggaatgcaaactaataagaaaaaagcaaaatattcagttctttggttgttgttacttaaaattgctaaaatgaaagtaaaatagggtgctgcatcaggacttgaagttggaccaagttcagatggggacatgtctgagcttagttaggccactagcctcaaagtcacacacaaaggagaaaattatgcagggacagtagaaagtacctctgaaacctgtggaagacagtcaatgtgaaggcagggcaaaaccaagtaactatttaaactattagagtaggtagttaggtaggcatgagcaggacaggagcgaggccccatccagaaatgccaggcaaccatcaggtgatggttagttggttgttaaactgttgctctaaaataataattgttcacagccaatgcagggaaaaacagtctcccaataaatagacaatacctgaaactggtgatcagcagcttcctgataagatttcaggagttgggtgaacaggctcaagaatgcccactaaaaagcaaaatggcagagattaactggtatatgatctttctctaggaaaacttgactggtaaggaaaaaatgcctcaaatgagcatgtgtacaactttggcaaacacagtgtgcatgttgcccctccccaagtgctggcggaccagtgtgcatgcagatagcccaccccaagggaagaatcaggggagaagaaatgcaaaccttggaacgatgccaatgtattctttcctccttgcaggcaagaatcgtttgctgcagacctgttggattcacagctggtaacaaaaccggagagtatagtgtgaaggaattgtttcatttttgtagaatggtgttatcagcttcctgaggaactattgctaaaatggattataagaatgacaaatgtaggggcagtgtctttggtttcaaatcttgcagagtgaagagcatgtttgggttgatataggacccacagctgaccatttgaacaatcacagatgggtatatatgatccagatatgtaggttattccgcaaggaacagccagtctgatagattggataaaagccattataagatctatttgagaaggtggactgttgaactccacctataaatgccaagtggaacaccttacataaggcagctgatacaattcatatgcaagccatgtgtgactggctttatgaggacatgaatattcactcagtgaatatgtccattacccaggtcacggtaaatactctggttaaggggaccccatgtgacattactcctgcagactcaaatagttcaagaagccttatcaaatttgtggactgagtttcccctcatggatctcacagatgctaataaaaacattaggttaattaataagagaacagtgaaaggcaaaagggagagtcaaagactcatccccggaagatagaaattttaaaatggttattaaaaaataaggtgaatgaagaaaacattgatggggtgaaactaagaagaaaaagaaaggggagagtcatgggactcgtcccagcagaatggaaaactttagatgcttattaagaaatagaatcaataaaatagacattgatggggttaagcaaaggtcttaatacaacactattgtaggttggatggaccagagggggccccatcttgttccccaacattaaaaggccgcaaaccagtctgctgtatttctgccagcttggagaaatttaaaaagctggaaggcagagattacaatgaaaaatcagatctaaaattgcctggggcaacagtcaggcagactaatcgagataaagattaataaaagggccagggtccttgggctcaatccttggctggggacccaaagctttttacacaagagagggtaaaatgacctgggggtaaagaagagaagatcctgaaactagaacataaaaatgtaagagttgataggactatggaagttggtatatttgaaaacactttatgtgaagtgattgcatctcttttacctgatttttttttttgtgggaatgaacaaagtatctcattgggaaatatttctcctccctggtgctgtaaaacagaaggcatgtaataatctgccctcaagcaatattaattggacatgctaaatgggaaccagtgagattgcccaagtccacacagtgcagagtagaagctagaatgctgttatggataaattctccacttgataagcctctgtgatgctatttcctggatcttgtggcaaaagcctctgagcacctcccagcaacatctactgggactttggactatggaacttccatctgaggggcatttactgctttgctgtgaaatgttaggtgaagctaccgctattaacacctgaaatacccatgttggcccagcgatgtcagagaaacattctaacagggatggcagtgcccaggagagttccataataaaatggacatggtttatcgaggatcatgccacctaagaactgcaaggaggggatactcttgagcagggtgtttcttttctcctgagactgactctggaactgtgtgagaaactgctggattctacagtgcctgataaatggctctcaactcatgagaaagagctacttagtttgtggccggtaattccaaggtaaatggacaccattgtgtttggaaggcagctactttgataaaagaaggtaaaaacagatctgcttggtgggctgaattgcacactgtttttctaacagtgatggaagaattgatcaatggtaaaagcccctgagtttgggtgtttactgagctgtgggcagtgtgacccatggcctggccatacactcaggcaagagggccatggaaatttggcctattaaatggatgcacataggagcactgttctatggagatttgaggggtgcattaaagaagaacaagtgaatgcccatcagaagaactcccttccaggttcagaaagtgactggaattgacaagcagatatccccatgtactcccttgaagtggccacctgggcctttgaaatgagtggatatgggggtattgtaacagggcagagatgggctgaatgtagagatggtttttttgcaccttctcaggcacaaaatgccagaaagaactgttgtgtttctcaataagaaagccagagactgctgacggctttgggacagattctctggtgggaaggccctgaacatagctggcaagtgcgacaaatgctggtagccctggaggctacaaatgggtcttgacaggaatagacactggctatggagtggatgttgcttgcccagaagaagatgaaaattctctgagtgccataaaaaaccggaacagaagatattacatggatatagatggctaaccatcagtttttcagaccaaggaacacactgtacagcccataagaatagtccaacaatggacaaagagatatccacctagagtaatagtttgatagagcagtagagcaggcaattgaaacattgattgtgtaaaacagggggagataaaagcacaaagggctggctcacatgccttcctgtctgctcacactcaacatgagcaggactagagtgtttctgctagattttttttctttgtttttctggttgatctggggaacagggagttgggaggatgctggtatgactatgccattcttgccaagggacgagtacactggtataacaaatgtaagtttttctttcttccccaaatcacctaaaagaaatttatttttttctcccctggctgatgcagtggtcctaggaccaggactgcaattacaactgctggattagcaggggtgatttctaagcaaaaacctgtaactgtgttttgaaaccttatatcaaaattcccaaaggcatgatgggagtgggttgtgtcttcatgctatctagaaaaattggggctatcagtgaatgcagctatattgcctggtggtaaaaatagctcactagttctgcacctatgtaaccttacccggtctgaattggcgtggactgaggaggagctaattgctagacttgtattactacttgcaacgtagaccggcactgtggtggttctaatttctcttccaaaggtgaaaaggtttaggtattaatggagagaaggagaaatagtagctgagagtaaataaatgaataaatgagttattaattgagaaaaattcagtattacataacaactcaaaagagtctcagagcaagagatgacattgtctcttagcttaattatcccagatgccttaaagggtgaagctgcgtatttactgaggccactcctgctttcgagacctgacaagattgagaggaaacttgcaaccctgagtggcctcatcctggaagacattcaaacaatatgaaggatttgattaattgttaatgattgtgcataatatatatatttttgaagtaaaggcaccatggtggaaaaccagggagtggcctgtggtgttatgatatacactggttttagtccacagttcctggcttataactcctatatcccttgttacaatattttcttttttttatataatgttgggtatgttaggcctcaggagcaagcctctgaccttctcctgccttactttcactctaatgtttccccactttctaattgtgacgcttaagactctcacaggagagggttccatcctatatcctgagggaaggaatgctgatgtcatgaagctttcataaaaacccaagaggacagggttcagtgagcttccggatagctgaacatgtggcacttcctggagggtggcgcacccagggagggcatggaagctccgggccccttccttcataccttcccctatggttctcttcatctggatcctttgcaatatcctttataataaaccagtacatgtaagaaaaaaaaaaaaaatgtacttacagtttccttccttccttccttctccttccttccttccttccctccctccctccctccctccctccctccctccctcctttctttctttctttctttcttccttccttccttccttccttccttccttccttcttccttccttccttccttttctttcctctctctctttctgacaaactctcgcactgtcaccaggctggagtgcagtggcatgatcttggctcactgcaactcctacctcctgggttcaagctattctcctgcctcaacctcccaagtagctgtgactataggcacatgccaccaagcccagctaattttttttgtatttttagtagagacggggtttcaccatgttggccaggatggtctcatctcttgaccttgtgatccacctgcctcggcctcccaaagtgctgggattacaggcgtgagccaccatgcctggccaacctacagtattttttctaaggccatctctagctgcatacttaccacactaggtaaattttctgtaaaggcatatgccataaatcaggatttttttgttgtggttttttggtcaagattagtttctacatatcatccagtatttgttacgtctaatgagaggttgtatatatacatgtgaatgtttcaggaccatatggcaattattccatttaaaatattgctgtcctacttctcagaaaaaaggcaaggcataaattattgtttttactattttaaaaaatgtagcccttcatcagagcttagatctataggtataaattactaatgctcatccctttccagtggcaaaaaggagatatcaaattattttgagatttgagtaagaataaaattaataaatagcaagaggacaggtgtgtgaaagttttcatatgagtaacgctcgggttacttatttctttccttttaacaagaattatttagcccttgcctggctcttgctgcagtcaatttgagaggaaaggacatcttgccattgattttaattattcccagtcatcccattccttttttagtagattgaaactctcttgggctggttttctagctccacctacgtattggttggcactgtcttcatttaattttgcctgttattattccttcataatgcctttccctgaagtgacagaacatccttcacctgccaaggtcagcagtttgctacaggagatgacacttccaggatcatatgccaagtctatgtaagggcacaagcgaacggtggtggtaactaatagtcttaaagttatcttgtttattcttatttcagctttcctgctatattttttgcatactctctaaagtaatacatggtaattggaaaaatgtgagaagataaaaaagaaaatcagagagaatgagattgtgtattaattagttatcaccaaacaaaactccagactgtataaataccaaacaaactccagactgtataaaaagtaaaaacaggaaataatcatttcaaaatttcattggattaatgttttctattcctgcattcttccccctccttcttacctcttcctcctcatctttcttcttttccccatgtcaagtaatttccaagatggcccaggaataaagatatgcagttacaaaacattctagccctaactagtaagaacaaatattctctttctgtgaatagaaaggatagatggatctgtatatacacagacttgcatgtgagtttttagaatatgtacatcagttagattgtgttaaggcacaaagccatagagttatgccccacattaggaaatacttccaggaatgtgtattgcatgaataaataaatgaaccaatagcttactatgtgtcagattctttgctgtcctttaaatagatgatcttattgaatcttttccccatattaggaaatacttctaggaataagtattgcatgaataaatgatgaaccaatagcttactatgtgtcagattctttgctgtcctttaaatagatgatcttgttgaaaattcactgtgaaaagaatggggatctagcatgataaaaagatacttgttgactttatggcaggacacaagttacacattttgcagacttaagagaggctgtgtggcctgaattttgaagtagtacctactgctatagtagtgggcactcagattttgtagaattaggcttatcagaaatcctcagtttaattgtacattctatgcacttaatatttgagatttgttacattgtattggtgtctaatattttattcattccctatgagtgccagaaaaggagtgaaggtagagaatatttcatttgtcagtattccatgaaactactgattatgggaaattcatgaaagagcttacagtttaaaattctacaatggattaattaaatatatatatctgattacagctgaagttcaagtccctcagatcaatcagcagtattttcagagataagtagatttatttcttaattaattaattaatatttatgtgtctattaaatatggttcttcattgcacatactttgaaattttttttcttttttagagagagtgtcttgctctgtcacctaggctggagtgcagtggcgcaacctaggctcactgcaacctctgcctcccaggttcaagcaattctcatgcctcagcctccagaatagctgggattacaggcacgtgccaccatgcccagctaagttttatatttttagtagagatggggtttcactgtgttggccaggctggtctcaaactcgcaacttcaggtgatctgcccacctcggcctcccaaagtgctgggattgcaggcatgagccatcacacctggcccatactttgatatttttaaccatcaaattagtgaataaattactgaataaaacttaaccatatctcttccatgggtagggagactatggcatcacaaaggaacagtgttgttatatctttacaataggaaacattggacaaagatggaagagtaaggacaatgttatcattttcattgttccatcatcataatgtgccatgttgtgtatagacttctctacactgtgtggctgcttctttggaatacacagtcctaagcattgctgggattgtgaatgtcaaactactactatagatattttgtatctcagaacttaaacttgatgcagtaattattgtcttaatcattggttttacccttcctatcattgtgttggaataaggtctttcctgaagtgagtactataagcaatagtatagaaatacacaagagacaataaagtacgtgaggaaggctgggcacagtgggtcacacctgtaatcccagcactttgggaggctgaggcgggtagatcacctgaggtcaggagttcaagaccatcctgaccaacatggtgaaaccctgtctctactaaaaatacaaaaattagctgggtgtggtagcatgtgcctgtaatcccagctacttgggaggctgaggcaggagaatcacttgaatttgggaggtggaggttgcagtgagccaagattgtggcattgcactccagcttgggtaacagagtgagacattatgtatatatatatgtgtatataaatatatatgtatgtatgtgaggaggataatagttaatcctaacagattaacttggaatcattcaataagtagactgaactaaaattgggaagccattatttggtattaaattatgggcaccaggggtaaatgactgactaatagagcaggaaacaccagacagagaaaggaatgaaatacaaatgatggtcagtagggaggaggtggtcaaggaaaatgagttatgaacagaaagaactctatttacaggctgacactataaatgcttgtaaatgaaaaataaaattctaaggcctccagtgaactgaatggaaccctcatcttggccaagggtattccaaagttaacctgaaacactagttcaagccatgacgggaatgagtggtcagacatgcctcattataccctcgtcctgttggaattcagtcactactgaccagcattaacattaaaacagagaccttggccggatgcggtggctcacacctgtaatcccagcacccgcctcagcactttgggaggctgaggcgggtggatcacgaggtcaggagttcaagacctgcctggccaagatggtgaaaccccgtctctactaaaaatacaaaaattagccgggcatggtggtgggcacctgtaatcccagctactcgggaggctgaggcagagaattgcttgaacccaggaggcggaggttgcagtgagccaagatcgtgccactgcactccagcctgggtgacagagggagactctgtctcaaaaaaaaaaaaaaaaacagagtccttaagacaacgaagggagacactgtagcaataagagaccaacatagcagacagcaggccctgaagaaaactgaaatattttaccccaagatatatttctttgacatattttgaaatggccctgcaatggtgtctgttgtggggaaaatccatattctgtaaagaattcccttccttttccaagtctttttcctgatccaggagagaattaactaagaatttggcacctttttaagtctgatgagaaatatttacagtgtattctctctgaagcctcccatctggaggctttatctgcataataaaagccttgatctccacaacaaccgcttttcttaacccagacactcccttctattgattccacgcctttagataaactcttcaactgtgaatccacctatgacctgaaatcccactccccacaagccctcccaaccaagttgagttgtcccacctttccagaccaaaccaatatacatcttacatgtattgattgatgttttatgtctccttaaaatgtataaaaccaagctgtagctgaccaccttgggcacatgttctcaggactcctaaggttgtgtcacgggtatgtttttgaccttggcaaaataaacttctaaattgtttgggaactgtctcaaataccctttgggttactccctgaactatgccagaaaatcattgacattgtgaagggaaaatatcttgggtcccccaaatcactaagctaaagggaaaagttaaggttgggaacctcttagggaaacctgcctcccactctattcagtcacccctcttctcactgagataagcgcatatctgattgcctcctttggagaggctgatcacaaactcaaaagaatgcaaccatttgtctcttatctacttatgacctggaagccccctccaagcttccagttgtcctgcctttccagaccgaaatgatgttcatcttacatatgttgattgatgtctcatgtctccctgaaatgtataaatccaaactgctctgactgccttgggacatgtcatcagaacttcctgaggctgtcatgggctcacatcctcaaccatggcaaaataagctttctgaattaactgagacctgtctcataatttgggggttcatgttttggtaaccacagagggattctaagtagaggtgcccctgacctttgacaaatctccttttggtgtttggtatcagcttgagctatctttatggctcaaaccaataggataatttgctgaggtctggaagcaccctctccagagaatccctgatcttccaaaatttggttgagatctacagtttattttggtacgtaactcctttttttgaattttacttgcttccaacccaaggaaggcaagttttccctgcttccataatgatggaaggcagataactcctttatggagtttgagctcacttccaacagggaagatgagtttttgttgttgtttgtttatttgttttgagacagagtcttgctctgtcacccaggctggagtgcagtggcacgatctcagctcactgcaatctctgcctcctgggttcaagtgattctcctacctcagcctcctgagtagctgggactataggcgttcaccaccatgcccagctaattttttatttttagtagagacagggtttcaacatgttggttaggctggtcttgaactactaacctcaagtgatctgcctgccctggcctcccaaaatgctggggttaccggtgtgagccaccgcacccagcctgatgagatcccctccgctgccccctacttctaggatggtagagagcagccttcagcctgaaatccatccctaggcaagtaaatgatgtcaggcctctgagcccaagctaagccatcgtatcccctgtgacttgcacatacacatcccggtggccggttcctgccttaactgatgacattccaccacaaaagaagtgaaaatggcctgtttctgccttaactgatgacattgtcttgtgaaattccttatcctggctcaaaagctcccctactgagcaccttgtgatcccccactctgcccgccagcgaacaacccccctttgactgtaattttcctttatctacccaaatcctataaaacggtcccacccttatctcccttcgctgactctcttttcagactcagcccgcctgcacccaggtgaaataaacagccatgttgctcacacaaagcctgtttggtggtctcttcacacggatgcacatgaaaaatgaagtggggtttgtcttggttaaagttaagatttccaaccgcctgatcttaatttctccttaccattagagtgcttggtaatcatgtaagttgtgcaattgtttgttttgcttaacttttgttttgttattgttttttgtttctggtttttgttgttgtttcagtctttttctcattgggtttgatcaactctatccaactagatcaaatccaaaggaagttccaaattatggaacaaggcctctgaagtggctaaattcccagaaaaacgacgacaacaacaacagcaacaacaactacaaaaacggtggtgtggtagcagagaaatataccagcaaaaggaaaaaaaagaggaaaggctttgattttgactactaataggctttatttacatagcaaggtggcctttttgctaatcaggccaaactgaaagagcaatggctattacttctgaaatagcagcaatttgtcctagctgaaatatggtaatgatatttaaaaacatattttttaaaggggctcagtggctagtcagcttaattaaaagctaacatccaagatgtgtgtgtgtatgtgtgcatatgtgtgtgtttgtatttaaaagaccctcatgcttttgtttttgcttttctcctaggaccttgtctctttttcgagcaaaagttttttcttctcagttgactgaattctgttttcttcacttgtttgtttctgctctctctcctttctcttgcaccctctgctgcatggggaacctaaaatagttcgtaatagcctggggttccttaaagaaaacagtgaaggcaccagactcccttcggaggagaaacctgtttttccttatggaaccccaagaatgcaaacagacaaggtcctctcagctcttaaactgcttactttttttcactcacgtccgtgtgaagagaccaccaaacaggctttgtgtgagcaacaaggctgtttatttcacctgggtgcaggtgggctgagtccgaaaagagtcagcgaaggcagataggggtggggccgttttataagatttgggtaggtaaaggaaaaagggaggttgttctctggcgggcaggggtgggggtcacaaagtgctcagcgggggagcttttgagccaggaggagccaggagaaggaatttcacaaggtaatgtcatcagttaaggcaggaacaggccattttcacttcttttgtggtggaatgtcatcagttaaggcaggaaccagccatctggatgtgtatgtgcaggtcacaggggatatgatgtcttagcttgggctcagaggcctgacacttttgtattgtgttacctggttttttgtttttgtttttggctaacatagttattgcaacagagtttgctcttgggtttttaaggaagagtgtgttttagacactagaaatgtctttgcttaaaaaaaatttttctaagtgcacttaaaaaaacttaaaaaagtatcatgtggtctaaccttattataattctcccattctggagaccctggaatcagtgtgggctctgcccacagctcagggatccagttaaaagataggtagttcctatctaaataaaactggtctccttatccaatcttacgatagatttctgtaattttatgtttgatttggcatctatctttaatctccctctagcatcaccagactttttctctcagtaccttgtgatgtaaattttgctatttgcatttcacctgagtcgtttcctttaatttgcaaatttaagcgtgtttacctgacaactgcctagggttgtgaaacagattatcaaaaatctgaaagtctaagatagggaaaaaaaggtttttataaatctataagatgtaatttatcagcatgcctaatatgtctatgtatttatatgttatgtacagaatgtttcactactcaaaatagataaaagagctctaattaattggcttaagaaaacaaaaatgcttgaatcaaatactttattggaaaaaagaaaagactagtcaaatgcttattcaagtttatgtaacttaagtaaaatctttaataaataagctagctttaaaattattggtaaagtaatattagaaatgtcttaagaattgccagcatacatttttgttttgtatttattaatcaagcaatttcatacttatccctgtcaaatgctatgaggtgtcaaaatttggcatagtggttacaaaactataaaaccagcccaagaaaatgatctttccctgtgtaatctttaaataaattagagattgatattggtgtaataagctacatcattttattttatttatttatttatttgtgtttttttgagacagtcttgctctgtcaccgaggctggagtgcagtggcacgatctcggctcactgcaacctccacctcccaagttcaagtgattctcctgcctcagcctgagcctcctgcctcagtccggagtagctgggactacaggcgcatgccaccacacggagctaattttttgtagttttagtagagatggggtttcaccttgttagccagggtgatctcaatatccttacttcgtgatccgcccacctcggtcttccaaagtgctgggattacagtcatgaaccaccatgccctgcctttatttactttttttgagactgagtctcactctgtcaccgaggctgtagtgcagtggcatgatctcagctcactgcaacctctgcctcttgggttcaagtgattctcatgcctcagcctcccaagtagctgggattacaggcatgtgccgccgttcccagataatttttgtattttttgtatagacagggtttcgccatgttagccaggctggactcaaactcctgggctcatatgatttgcccgcttcagcctcccaaagtgctgggattataagcaggagccaccaagccctgccaacatcttgaatttagtaagattactgtgacttctaatcttgtggcttttgtcggtctagtccacaggcagtaaggtttgttttgggaaaggactgttatcatctttctttcaaagctaaactataaactaagttcttcccaaagttagttcaaacttttatcaaagccaatttaaaagcctatgtaaaaaaataattattcttgctgagctgtatacaaataatttggccaagtatcataaagcaaatgaatcctatcatgatttgtcttgagtaaaaattaaaaactggagagagaataactgtgtttcaaaacctatactatacctgttgttagattctaggtcttgcctaatgtttttcaatttttattattttctacagtttggaccaaattctaatttttcttggctacaagtcttcaaaataatgttctcatttttttcttcttttttttccccacttttcctaatttggagtcactgaaaactaagctgtgctttcgtaaagccctgtgaactgaagctagacaactcgaacttcagaagaaaataacagcaacctatttacatacataagccactttcctacctgcctccaatgtaaggatttcagagtaatgtggcctatatcaattttccaggattgttcttttgcttattgttgtttttctcccttcctccccctattttatctttaaaggatatgaagcttcacaacttctaaaaaatgagctttcctaataactcaggacctatctgcctaggaataacccattgtacccatgagaaattagaggaaatctgagatcagagactcattttcttttaacatgttttctccaaagattttaaaaaagaaaaggggggaaatgtgagagaaaaatatcctgcccccccaaggttactaaactaaagggaaaagtcaagctgggaactgcttagggcaaacttgcctcccattctattcaaagtcaccccttgctcactgagataaatgcaaatctgattgtctcctttggagaggctaattagaaactcagaagaatgcaaccatttgtctcttatctatgtatgacccggaagtcccctccaagcttccagttgtcctgcctttccagaatgaaacaatgttcatcttacctatgttgattgatgtctcatgtctccctgaaatgtataaaaccaaactgtgctctgaccaccttgggcacatgtcatcaggacctcctgagactgtgtcacgggagcaagtcctcagcactggcaaacttactaaattgactgagacctgtcttagatttttggggttcacaacattcattagcgattgggggtctaggactgaaatttaaaggcatagatgaagtctgacagatccaatctgatgttaactttgggattttctttagttaccactcagtgccccagtcctccttaaaatactttatacctccaagtctctttccttccataaaagccaattgtttctctaacactaggtctctgccttgctgttacctgccttcagaacctggggtcttcccttcatagttagggttcccaccagctaagaattcacggcctggatctctgcatattgcctatgctcagattgccttgctgccatgtcccacctatcctgtcacacttttctcacctggagtttgatggtttccttgtcactcttcctcccttgcagtgtgctctactttgcttctctgggcagacccttgcataatcctgggtctgcccctatatgcctctagtaggagttgatgctgggcttgtattttggatagtcccaatggtaaataaaccctgactgtcgttcattcatctgtcaaatatcattatgctctaccatgtattaagcattatgctaggcacttgagatataatgagagaaataaccatggaggaacacaggaactctcatacattgctgcaatttggcagtatattgtaaagttgaacaggtacatgccctactctgcagctaattaatgtctcggtatctacctataaagactcttgtttctcctcatttacttcatttgcttttctttcatttacaacatattatgtaggacatactttttttttttttttttttttttttgagatggagtctctctctgtccctcaggctggagtgcagtggagcaatctgggcttactgtaaccgctacctcctgagctcaagtaaggtggaggttgcagtgagcccagatcctcctgcctcagccttctgagtagctgggattataggcacatgccaccaagcctggctccggtacatgacttcaggtgatcctgacctcagatgacccacccacctcggcctcccaaagtgctgggattacaggcatgagtcactgtgtctggctgagcatgcaaaatttgtaatcggtagacattgtttataggcatgtttcataattataaaatgaattaaaaatcagtcacataaatatatgggctttttcaaaataacccaacatggaaaccttgatatccttccctagatctatggcagtctttgtagtctccatgacattgcacagcttgggttcagaaatgactctctagaaaaactgaaacaccacacctctgtagataatgatgtgcagctggggctcagccacttgtgttagtgaagttcctttcacaccaaagatactcaccccacttccatattatatccaatcatagtatttcaacttctgtcaaaattcccagtctccaactatggtgcagcagatcctttcaaatgtaaatacaatagcataaacttatatactgacaattctgtaacatacagaatttcattctgtatgattctatttaatagagtttcaaaatattcatatggatgaccataaaagaaagtaagattaaagatgtgctctttatgaaaaggtgtaacccacatttcaatcagggatactttataatctttaaaaaacacaccattgaccaggtgcggtgactcatgcctgtaatcccagcactgtgggaggctgaggcaggtgaatcacctgaggtcaggagttcaagaccagcctggccaacatggtgaaaccccatctccactaaaaatacaaaaatgctagccaggcatggtggcaggtgcctgtaattccagctaccagggaggctgaggcaggagaatcacttgaacctaggaggcggaggctgcagtgagccaagattgcaccactgcactccaggctgggtgacagagtgagactctgtctcaaaacaaacaatcaaacagccacaccatcggccaggcgcagtggctcatgcctgtaatcccagtactttggaggttgaggtgggcagatcccttgaggccaggagtttgagatcagcctgggcaacatggtgaaacccagtctctactgaaaatacaaaaattagccgggcatgatggtgcatgcctgtaacccagctactagggaggctgaggcacaagaatcacttgaacctgggaagtggaggttgcactgagccgaacttgcgccactgcactccagtctgggcaacagagatagacgctgtctcaaaaaaacccaaaaaaccaaaaacaaacaaacatacaaacaaaaaacaccattgtttttatttgtattttttccctatttactacttccacaggaaaattgtttgatttttgctctattttaagccaaacttcatatgcagggtaaggctgaggcaaaacaagtgagaaagtggttgtagataaatgtaaacgaatgaccatgagatgaccctttcagaacttgtgcaacacgtatgtcaccagccccattagcctgtgttaggaataacgttcaaaatcctaaggaaattgaacactcgaacaaaggattcttagcaaagcaattttacttctgcgcacaggggtgcctccttggccagttacatgagagcacacctgaacaaaggggcaggggaacctttatttctgtcgcaagtcctgccccgtacgctttttttattggccagggtcgggtcgtacaatttaaactaatctcggttggctaagcatttgattttttttagatagggtgggcacgtacaagaaagtggagaggaaggctggacgcggtggctcacgcctgtaatcccagcactttgggaggccgaggcgggcagaacacgaggtcaggagattgagaccatcctggctaacacggtgaaacctcgtctctactaaaaatacaaaaaaattagtcgggcgcctgtagtcccagctactagggaggcggaggcaggagaatgacgtgaacccaggaggcggagcttgcagcgagccaagattgcgccactgcactctagcctgggggacagagggagactccgtctaaaaaaaaaaaaaaaaaaaaaaaaaaaaataaaggaagtggagaggaaggggaagggttgtctgcaatgagctagaaagttagtctttttttttttttttaaataaggaaaggaatgcgaggtggtactgataatgcctggtactgtagcgtgcctgggcattaaaggagaaaaacggaaaaacggcgggggtactatgaattaaagaataaaagattgatcagattatttgaagagaaaccgcatcatatcccacacctgtcactacataatgaggttatgcttcatttttatatgtatataattatgaaaaaagactctgtctgtttgcttaccagatgttagcatgtatttttctacaacattgtttggagcgtttcctagagtactgcttggctttttgttcaggagccttgctgcagctgggtccttccttgcagccttcccaccctgctgactgacaggatgctacctttattgctgctgatgtttatcagactgatactctgcctctaattgcaactggcattgtctctccagctcacaggaggggaaactgttcttgtaattcttcgtaatacagttgaggcccggctaggaccttggccaggcttgggagtcatagggtttgcaaactcaaatgtcaacagaagtctggctggtaatggaagcgtgaaggctgcatagtttaagaaatgtgggcatgccatttggctttaatgttaggaaataacagccagtggccaggcgcagtggctcacgactgtaaccccagcgttttgggaggccgagatgggcggatcacgaagtcaggagatcgagatcatcctggctaacatggtgaaaccccgtctctactaaaaatacaaaaaaattagctgggcatggtggcaggcacctgtagtcccagctactcgggaggctgaggcaggagaatggcgtggacccgggaggcggagcttgcagtgagctgagatcacgccactgcactccagcctaggcgacagagcgaggctccgtctcaaaaaaaaaaaaaaaagaaaaaaaaagaaaagaaaagaaaagaaataacagccagtatgagtgaactgacgacgacatactgcatttaaagggagaagctgctattcaaagccaactgattgttgatatatggaaacagggcttagtttttccagttacgattttgcaaaagaactctgcaatttatattttttaagggaaatattcttatttttcaatactggcaactaattctttttttttttttttttaaagaaagtgctgtggccaaaccaaatatttctgtgggcctccatagaactatgaaacactaatctatgaccattgactaacaactgctaccggaagtagttacttgctactcccaggactcacagtccaactatcttttagattccctgcatagcaaccggcagacctccatgtagcatgagctgacacagacagacatacagacatacacacacacacatgcacacgcacatttacagagtgcatatgaatgaaaatcccatttatatcaggagaaaaacccacatcctccccaatattggtgttgggctccacagactactcaaagccatcactgtggtttgcccatttagtctcaaataacactttatgtggaagagaaatgttacattatagtccatatgccactgcgtcaaatccaatgcactttgcattcaatcttgccttcaggatgaggtaaagaaaagttgctactgtatgcatggcataatctcatctcctatctcctggaagcaaatggttaaacaaaaattataaacacaacttccaagaacaaaatagtaattttcagtagcaagtagcctgaattcagatttaagataaactatgtctaactctgtggaggttcagcctggctaataaatcaaatttacattaaggtcagggctctggtgggactattcccttatattcaggagtgtcttcaagaataatggaaagctacttgagtacaagagtaaaagggcccactcaatttccacatcagaatgcgggaaaaccacatgccatattctcattggaaacttctcctgcttcaaaatttaaagttcattctgcaccagataatccatttgattaaaagaaaacaacttctgagggctaacctgttaaataagcccacatccaaagtcatcttaaaggtgactatcagagcaataaaatgaaacagtaaccctgcttgaaggcaaaacaaatttgaagaacaattcagccagaggtagagtcttgaagtctaacaccagctgtaagaaatgaacactatgctggagaagaggtgagagatcaggctaccttgtttttgagtaacctagcatgtagatatctattgtgcaggaagatgtatcaggtaccttggaattacagaactaatgtctatggtgctgaatttatgctaagaaatattctgataatttaattttcccattaagaaaaagtttgctggtcaacctgaaaaatatggtctatttggccagattgacaatatttctcattataaattaacaaataagttttctggttatatactttagttacacaaatatattgtgtaattgtatgatatgattacattgagagggtctaaatattttatatacttaagaaatattaggtaagttgattttaaataggcattacagatggcaacataagtaaattaaaatatcaccttatacagtcaactcatttttaacttttctttattcatgcactggaaacatgcatttttatttttatttctcaaactattttttaagattaaatgaattcatttttctttacctgcagaaaattgccctgtcattaagaaagaggaagaagagaacattcatatttattgacagcattgtttggcctcttatatatataaaatgtcatttgttttgcacaataaccctggggaaaaaaggtattctccctgtgtaataaaaataggttgaggcatgtttagtaaaacatgccctaggtcacacagctagtaaattgtgggctaagatgactcttttattctttatgatttttttattggcacattgtagcctaaaattctaaaagaacatataatcttgtgtgctactaaaaattttaatctgctctacccaaggtttaagtagtatttgaatgagccagattgggagaggccgtgactcagtcagagtcagactgtcagacttgcagtgttgtttggaaagatgggtttctgagatgggcattaggccagggacatcaggcttcaagtaaatctaaaatctaggagattattctttgtagggtagaggagacgcaaaggacataggcttaaaataagcatattaacctgtgcagctgcattaatgagtgcggcttcaaaagaatctcttcagtaacagagaaaataatgactatattcatacatagtaggccattgacagaagacccaggaataagatcagccatatattgtatctgaaatatggctaaagtgtaattaaatatttaatattaaactaaactcatatagaactgggaaataagaccatcaaattctcagttattgttatctctgaaagtggctttgtttagttgataatttgactagggttagaattataggtccaaatatatacatatatatatatacacacacacacgtatatatatatatatatatatatatataccgtgtatatatatatatatatatatataccgtgtatatatatatatatatatatatacactttttttccaactcaatattttgctcaagtgtttaattgcaagtagtatgctgatgaaaaatctgttgttaatcttgttcttattttcctgtaaggaatctttcttttctctctagcagtgtcagaaatttcctttttatacttagtattctaagatttcaccatcttgtacctgtctttttaattttgcatggctttcactgacccattatgtagtttcatgtctttataaagttctggacaattttaggctattacctcctgaaatattttttccctacattctgtctaaatctattgaaaagagttacgagtgggtaggtaatttggtgactggtctcttggtatgacagcatctcattccttttggtgtcaccaactctctaatacactgccctatttctctgcaataagaactgtattcatctttcctttgtggagatagatattgctatttgtcttataggagggagaggagagagatactcaggggctgacctgtctgggttctccctttgtggggctccaactaatcatcctgccaatggcttttgggtacccctcctgctcctggatttcattccttccaggcatggagcatttatcttgttggtctcacctcctgggttagaacttttctgaaggaatcatgggctgtgacctctttcttttctgctcatatttttcaaagactaattattatttctgtcgttttcaccatagatatttttatttatttaaaaaataaattttccttaatttttatgaatttagtgtaagaggagggattatattaaatgctcaccattttaaaattagaagtctgtcttctatctttccttcactaatatgtgtgttttgtacttagtcatatggtcaaatacttgtacataaaattatctgaaaaagcaaatgaaaaattaactagatttccccgtcgtatttgcatgtattccttacaaacttacctcagtcttcattttttcctgctctgtccattttcatccaaaacatacacatatacatcatacagtcaagataagcatgcatatatcacaggtatctttaacacagtttgaagatgtaacccttcattaaatgatgatggagaaaaaataaaggtaaacttagagggtatagttgagagacagtattaaaacaattgacttttaaccttattggtcttgattatggaacggagatgggtgaatcgttcatttagatttttttttttttttttgagacagagtttcactcttgttgcccaggctggagtgcaatggcacaatctcagctcactgcaacctccgcctccctggttcaagtgattatcttacctcagcctcctgagtagctgggattacaggcatgcaccaccacgcccaactaatttttgtatttttagtagggacggggtttcaccatgttggccaggatggtctcaatctcttgacctcgtgatccacctgccttggcctcccaaagttctgggattacaggtgtgagtcactgcacctggcctcatttagagtttatgttatttatttatagcttgataatattttatcttttaatttttattattgtctaaatattcagatttagaggaaatattattttcttcaggcaaaataacagtcctgagaggcaaagtttttttgcttcttttttttgagatgcagtttcactcttgtcatccaggctggagtgcaacggtgcgatctcggctcactgcaacctttacctcctggattcaagcgattctcctacctaggctcccaagtagctgggactacaggcacacaccaccatgcctggctaatgtttttttttttttttttttttttagtagagatggggttcgagaccatgttggccaggctggtctcgaactcctgacctcaggtgatccacccgcctcagcctcccaaagtgctgggattacaggcatgagccgccacacccagcctgcttttaaaaatattatttttaagttattagtagaatggacttattgaaatatgtactttttaactgaaggtacttggcatagtaagtttaactatgtttaactctgttgatttgcttttacattttgtgcaatcataagtgtccttcagttcttaaatatccacagcaaatcaaatattaactctgtgcatgtttttgagtttttattaagtagtgtttatatcattgtacctattcttatagctattgcctacatccaagtaggcattttgtttagttctttttctttagtctctcgaaataatgaaaagtgaaaatttctataatttgattgactgttttaagtctttaagtatattacactttgggcaaaatgcctactactgataaagacagcaaagtttttacagatgtataattaaaaactgacaatgcagtataatggagaacacacagaaagttccctttgtagtagtaaaaatgttggtatgcatagaggtgggaacttcaatgtgctagtgtggagggagtggtgtggaagtggtatgccataagtgtggaaaggtaggtaggaaccggatctttcctggccttataggttataataaggatattagatctttttctcaagccaataaggaattttaaaataactttaaagaggggaatggcatgattagtctatagttttaaaaagtcactctgccttcattatgggaaatacattgggggcagagggtatacaaatgcacatagggaggaggatgtgcattgaaacatatacatttgtgggcacaaaataaatattttgggatattggcagattggctaactctattctcttcagacttcttttcaatattttctgaaacgtcaccatggacaaataataattaataattaataattcattaattaatcattaatacaggaggttccaagatggccgaataggaacagctccagactgcagctcccagaagatgggttatttctgcattttcaactgaggtaccaggttcatctcaatggggcttgtcagacagcgggtgcagcccagggtgcagggcggggcatcgcctcacccaggaagcgcaaggggtcagggaattccccttcctagcaaagagaagccatgacagacagtacctggaaaatcaggacactcccaccctaatactgtgcttttccaatggccttggcaaacagcacaccaggagattatatcctgcacctggcttggagggtcccttgctcactgctagcacagcagtctgagatcaaactgcaaggcggcagcaaggctgggggaggggcgtccgccattgctgaagcttgagtaggtaaacaaagcggccgggaagctcgaactgggtggagcctaccacagctcaaggaggcctgcctgcctctgtatactctacctctgcgggcagggcatagctgaacaaaaggcagcagaaacttctgcagacttaaatgtccctatctgacagttttgaagagagtagtgcttctcccagcatggagtttgagatctgagaatggacagactgcctcctcaaatgggtccccgacctccaagtagcctaactgggagactcctcccagtatgggctgactgacacctcatacagccaggtatccctctgagatgaagcttccagaggaaggatcaggcagcaacatttgccattctgcaatatttgctgttctgcagcctctgctgggatacccaggcaaacagggtctggaatggacctccagcaaattccaacagacctgcagctgagggtcctgactgttagaaggaaaactaacaaacagaaaggacatccacaccaaaaccccatctgtaggtcaccatgatcaaagaccaaaggtagataaagccacaaagatggggagaaaccagagcagaaaagctgaaaattctaaaaatcagagcacctcttctccaaaggaatgcagctcctcaccagcaatagaataaaactggatggagaatgactttgacgagttgaaagaagacggcttcagacgattggtaataacaaacttctccaagctacaggaggatgttcaaacccattgcaaagaagctaaaaaccttgaaaaaagactagacaaatggctaactagaataaacagtgtagagaagtccttaaaggacctgatggagctgaaaaccatggcacgagaagtatgtgacgcatgcacaagcttcagtagccgattcgatcaactggaagaaggggtatcagtgattgaagatcaaatgaatgaaatgcagtgagaagagaagtttagagaaaaaagagtaaaaagaaatgaacaaagcctccaagaaatatgggattatgtgaaaagaccaaatctacgtctgaatggtgtacctgaaagtgacggggagaatggaaccaagttggaaaacactctgcaggacattatccaggagaatttccccaacctagcaaggcaagccaacattcaaattcaggaaatacagagaatgtcacagagatactcctcaagaagagcaactccaagacacataattgtcagattcaccaaaatagaaatgaaggaaaaaatgttaagggcaggcagagagaaagattgggttacccacaaagggaagcccatcagactaacagcggatctctcagcagaatctctataagccagaagagagtgggggccaatattcaacattcttaaagaaaagaattttcagcctagaatttcatatccagccaaactaagcttcgtaagtggaatggcacaatctcatgcgccaaacaaatgctgacagattttgtcaccaccaggcctgccttgcaagagctcctgcaggaagcactaaacatggaaaggaacaactggtaccagtcactgcaaaaacatgccaaattgtaaagaccattgaggctaggaagaaactgcatcaactaacaagcaaaataaccagctaacatcatgacaggatccaattcacacataacaatattaaccttaaatgtaaatgggctaaatgctccaatgaaaagacacagactggcaaattggataaagagtcaagacccaacagtgtgctgtatttaggagacccgtctcacatgcagagacacacataggctcaaaataaagggatggacaaagatctaccaagcaaatagaaaacaggggttgcaaaaaagcaggggttgcaatcctagtctctgataaaactgactttaaaccaacaaagatcaaaagagacaaagaaggccattacgtattggtaaagggatcaattcaacaagaagagctaactatcctaaatatatatgcacccaatataggagcacccagattcacaaagcaagtccttagagaactacaaagagacttagactcccacacaataataaagggagactttaacactccactgtcaacattagacagatcgagacagaaagttaacaaggatatccaggaattgaactcagctctgcaccaagcagacctaatagacatctacagaattctccacctcaaatcaacagaatatacattcttctcagcaccacatcccacttattccaaaactgatcacatagttggaagtaaagcactccttagcaaatgtaaaagaacagaaattataacaaactgtctctcagaccacagttcaatcaaactagaactcaggattaacaaactcactcaaaaccgctcaactgcacggaaactgaacaacctgctcctgaatgactactgggtacataacaaaatgaaggcagaaataaagatgttctttgaaaccagtgagaacaaagacacaacataccagaatctctgggacacatttaaagcagtgtgtagagggaaatttatagcactaaatgcccataagagaaagcaggaaagatccaaaattgacaccctaacatcacagttaaaagaactagaaaagcaagagcaaacatattcaaaagttagcagaaggcaagaaataactaagatcagagcagaactgaaggagctagagacacaaaaaaacccttcaaaaaatcaatgaatccaggagctggttttttgagaagatcaacaaaattgatagactgctagtaagattaataaagaagaaaggggagaagaatcaaatagatgcaataaaaaatgagaaagaggatatcaccaccaatcccacagaaatacaaactaccatcagagaatactataaacacctctatgcaaataaactagaaaatctggaagaaatgtataagttcctggacacatacgccctcccaagactaaaccagtaacaagttgaatccctgaatacaccaataaaaggctctgaaattgaggcaataattaatagcttaccaaccaagaaaaatccaggaccacatggattcacagccaaattctaccagaggtacaaagaggagatggtactattccttctgaaactttcccaatcaatagaaaaagagggaatcctccctaattcattttatgaggccaacatcatcctgataccaaagcctggcagagacacaacaaaaaaagagaattttagaccaatatccctgatgaacatcgatgcaaaaatcctcaataaaatactggcaaacccaatccagcagcacatcaaaaagcttatccaccatgatcaagtgggcttcatccctgggatgcaaggctggttcaacataagcaaatcaataaatgtaatccatcatattaacagaaccaaagacaacaaccacatgattatctcaatagatgcagaaaaggcctttgacaaaattcaacagcccttcatgctaaaaactctcaataaactaggtattgatgacaagtatctcaaaataataagagctatttatgacaaatccacagccactatcatactgaatgggcaaaaactggaagcattccctttgaaaatcagcacaagacagggatgcctccctcaccactcctattaaacatatcattggaagttctggccagggcaatcaggcaagagaaagaaataaagagtattcaattagacaaagaggaagtcaaattgtccctgtttgcagatgacatgatcatatatttagaaaaccccatcatctcagcccaaaatctctttaagcgataagcaacttcagcaaattctcgggttacaaattcaatgtgcaaaaatcacaaggattcctatacaccaataatagacaaacagagaggcaagtcatgagtgaactcccattcacaattgcttcaaagacaataaaataccaaggaatccaacttacaagggatgtgaaggacctcttcaaggagaactacaaaccactgttcaacgaaataaaagaggacacaaacaaatggaagaaaattccatgctcatggataggaagaatcaatattttgaaaatggccatactgcccaaggtaatttatagattcaatgccatccccatcaagctaccaatgactttcttcacagaattggaaaaacctactttaaagttcatgtggaaccaaaaaagagcccacattgccaagtcagtcctaagccaaaagaacaaagctggaggcatcatactacctgacttcaaactatactacaaggctacagtaaccaaaacagcatggtactggtaccaaaacagagatatagaccaatggaacagaatagagcccccggaaataataccacacatctagaaccatctgatctttgacaaacctgacaaaaacaagaaatggggaaaggattccctatttaataaatggtgctgggaaaactggctagccatatgtagaaagctgaaactggatcccttccttatactttatacaaaaattaattcaagatggattaaagacttaaatgttagacctaaaaccataaaaaccctagaagaaaacctaggcaataccattcagggcataggcatgggcaatgacttcatgattaaagcaccaaaagcaagggcaacaaaagccaaaattgacaaatgggatctaattaaactaaagggcttctgcacagcaaaagaaactaccatcagagtgaacaggcaacctacagaatgggaggaaatttttgcaatctacccatctgacaaagggctaatatccagaatctacaaagaacttaaacaaatttacaagaaaaaaaacaaacaactccatcaaaaaatgggcaaaggatatgaacagacaattctcaaaagaagacatttatgcagccaacagacacatgaaaaagtgctcatcgtcactggccatcagagaaatggaaatcaaaaccacaatgagataccatctcacaccagttagaacagcgatcattaaaaagtcaagaaacaacaggtgctggagaggatgtggagaaataggaatgcttttacactattggtgggagtgtaaactagttcagtcattgtggaagacagtgtggtgattcctcagggatctagaactagaaataccatttgatccagccatcccattactgggcatatacgtaaaggaatataaatcatgctgctataaggacacatgcacaagtttgtttattatggcactattcacaatagcaaagacttggaaccaacccaaatgtccatcaatgatagactggattaagaaaatgtggcacatatacaccatggaatactatgcagccataaataaggatgagttcatgtcctttgtaggtacatggatgaagctggaaaccatcattctgagcaaactatcgcaaggagagaaaaccaaacaccgcatgttctcactcataggtgggaattgaacaatgagaacagctggacacagggcggggagcatcacacattggggcctgtcatggggttggggaagcagggagggatagcattaggagagatacctaatgtaaacgatgaattaacaggtgcagcacaccaacatggcacttgtatacatatgtaacaacctgcccgttgtgcaaatgtaccctagaagttaaagtataaaaaaaaaaaaaagaacaagaactccaataacaggccttgaaaaactaagcgtgaaatccaggttgtggaacgtttgaccccaggaagaatgtatttcatctgtgtgtagttcatctgtattcttgtggtaatcaagcagacaccagctagaccactagttggcccactgctcaagacagtcgtcaagaccagacatactaccgcacacgtagtcaactcctgtgcttcccataaaaaccgtctagctagcctgagaaacttgagatgatctttgtgacatgagtccaccatctcctctggttgtcaactcctgaataaacccatttttctccctcaaaaaacattaataattattaataataaattaacaataaatcattaacaataattaataattaataataattaataataaaaattaataaaaataaaataaaataaaagtattaaaaactctaataaaatataatacaatataatatataatacaatacaacataatatgtgttatggctaaggaaatttcagattaggaaggacacctaatttagactaaaagagaacagcttcctagagaaggtgaaagatgagttaagtgctgatagctggatagttcagtcagaccaagaaagaatggcttttctgaatcaaagaagaacatttatgtggatatcctgataaaacggaaaacagatcagagtacaaagtataccattaccagggatgtggctgaagagataggccgacaagatattagatattatgctaaaaatccaggatttatcctgaaatggtgaatggtaattgaaagatttttagcaagacagtgacatgatgaaactggtatttcaaaatgaacatgctagcaagaggtgggataatgtactggatgagaataagacgggaagcagagaggcccattaggaatttgattcatttattcactaatggtgataccaaatgcttagtatgtaacaactattgagccaggtgttagggacacagtggtcaacaaaaaagagggccactgctttccttcaaaggtttaaaatctagcacatcaataaaataatacagggaggtaatccagcgcttgaccattctctccctttaaaaattatgtgtgttactttattataatttaaaaatacagatgaataagaagaatgtgaacaaaatcagacatccactcaacctctatggaatgttaacattttattgtgtgtacatacttctagatgtttaaaaatatagtatgtgtatatattgtatatcatacaattatatgaataaatcagactgttctcaattggtttatgatctagtttcctcttaacaacacatggtgatctttccataaccataaatctatttatccatattattttttatgaggggatgatgttctactgcattttcggacattttaggtaggactattcaaaacaatgttagaatgaatattcttataggcaagttttaaatttcatttcattagattaaattcttagaagtggaataaaagaaaatgcacattttaaaggcctttgataatgccccaaaccctcctttataatcttttcttctggcttccataccatactttgttaggttttttttttttttttaactacatcagcaactcatacacagtcttcttcattagttcattgctgcacattgaaatcatctggggatttttaaaaattactgatgcctggctcccacccttagacataccaatttcattggtatgtggtacaatctgggaattggaatttttagaagtgcctcaagtgattcttacttgcagcaaaagatagaaaccactgtattcttttattttccctgtttactacagaaatttaagttccatcctagatctgcatcttaccttttttcacatgctcttcatatgtaatcataatttcacctcttccactctaaactctatgaatataattaaaaactcgtatcttgcacttttcctgaggtccagttccactttgttcattgcctataggaaagtgtgcactaatgctaaatatagaattagctctcaaacttggtgtatctcaaactgaattaagaggtctcccttactcttgataaacagaaaactaaacacatgtttaaaaaaacagcaacacctgtggggaaagatattttctacctttcagttggttgcaaagctcttgtcttgattctttctctaaaacatattttaaatcagtttcccctaccctttctattaccattaccacaacctctaccctcagagtagtaccactgtgacaatacttatctgaatatctgtcttgggagcactggcctgtcagagtagtttgcctgcaatctcacttgcatgaagatagcacctagtgaataccagtagatatgacattagggactgaaatcaaggtggaattaaaaatttcaacacatgtaagtaagagtgtgtgtgtgtgggaggaagtgggataatgtaggagaagggacagtgatcatttccaactacttgaagatggccactcttgggccaggaactcagcccagggttggagaatgttgagatacatcgggctcatcccgattgatttcaggctgcaaaggtcactttgagaattaattgacccaataatggaggaacaactataacgttccaggagaaagaaggctaaaaagcaaaactattttatttgtgttataaatatctgaatttttaaaaaatttgaactccttacccaggcaagtctgccataatttcaaccaaggaatactgacaaatctagaaattgagagatttataagctactgaatctaaaatatggaagcagctaagctgacatgactggggaaagtgaggatcctttaatctctgactgtgagggtgactgtccttgacatgctgtgaagagtagctataaaccatcacttcttgtttctcagatctcaaactattgatccactcagctaaaataaaagctccattgagcagaggccttgattgtacaattaattattctccagcagctctgagagtgtgagatatatggtagccatacaaaaaatattgagttaataatttctcatactggggccaaaacccctgtgaccatagtagcaatgtagtagggtgttcaagtgtgttacttctttagaattttagaaatgtaatttaagaattttttttttttttttttttgagactgaatctcactttgtttcccaggctggagtgcggtggctcgattctggctcactgcaacctccgtctcctgggttcaagtgatttgcctgcctcagcctcccgagtagttgggattacaggcgtgcgccaccatgcccagctaattttgtatatttagtagagatggggtttcacatgttagccaggctgatctctaactgctgacctctggtgatctgcccgcctcagtctcccaaagtgctgggattaacaggcgtgagccaccactcctggcctaagatcattttaataagatttaagagacactaatttctgtctttcaagagaggtactaatttccatctaagcaggcccaccagaaagtagatatggaaaaacaggacaagcatataatatttgtaaagcaaagcattttatttctagaggaagatttgaaatccatggaagttaggagataacacagttgttttagttatttgtcacactttaaagtcattgtagcagttaggaaatagtgagatcttggcaaacaaaatgtggacatctaggagaagccaaagagttggcaacactttttaagcatctctggcagctcctgtctagttggactaaaggaataccatatcctattataaatcacatttccctggaactcagcttaaagggcaaactttagaaggaaaacctccatcatcctcattcaatacttcagctactgtttcttatccgcatctaaacaaaggccattaaatagagtttcagggaaaggcagagctgccaggaatgatgcagagatggcctttttctttagtaaaccagaagcttaaatgggcatgactccataagattttttgttttagtaattagcaaatagagtttcaaattcaaattgacttgaagcaagcagaagttttaaattaattaaattttccaggaaagggaagcctagccctaggaacagagattactcaacttgtaatgcattcctcaggcctaagtatccacacctataaagaatgacttggacttgcaaaggtaatagagctacttaagaagaatctctccaacatccctctgagaagcagcccagaaagatacaaggcaagggaaatctttccagggagaagaactcaaggtgctgaatggcttttaaaggacatttctgagccgggtgtgttggctcatgcctgtaatcctagcactttgagaggtcaaagcgggtggatagcttgagtccagtggtttgagaccagactggtgagcatggggaaatcccacctctacaaaaaatacaaaaattagctgggtgtagtggcacacacctgtagtcctagctacttgggggctgaggctggaggatcgcttgattctaggaggttgagggtgcagtgacctgaggttgtgccactgcacttcagccttggcagtagagtgagaccttgtctcaacaaaacaaaacaaaacaaaacaaacaaaacaaaacaaaacaaaacagcaaagacactttctctatttccaagggagcaagtcaagaacattttatactgcctgctcctaacaagtgattattctcaagcccctttctttcccctaaatgagataattttattaaggtaattctgtctgtggtgcacctttatttgcccctctgaatccttctccacgctccaccttcctctacctgcaatgctatcctgggaggctgacctgcatgaaaaaccttaaaggattcttacctcctctggcttccagttgggttcagccaatggcacagcagtagataagaaggaggtggggcgggcgcggtggctcaagcctgtaatcccagcactttgggaggccaaggcgggcggatcacgaggtcaggagatcgagaccatcctggctaacatggtgaaaccccgtctctactaaaaatacaaaaaaaaaattagccgggcgtggtggcgggcgcctgtagtcccagctactagggaggctgaggcactagaatggagtgaacccgggaggcagagcttgcagtgagccgagatcgcgccactgcactccagcctgggcgacagagcgagactctatctccaaaaaaaaaaaaaaaaaaaaaaaaagaaggaggtgggaggctaggagctaggataagggtacttatcttaagcctccgttcctgtgtccctcagctgaaggtcactgctcatttcaggccaaatggcttcatgggactctccctcctttagtaaccgctggccgaggggcaatagctcagctactacaaaaccccgagctcttgaattataaatcagaattaccctacgtccacacttaatttccttcttgaaatctactctctacatagacaagtgaattttcccctccctgaccaaatcaggcctccaaatataagcttttgtagcttgcttaaattcttgattaatttttactattaaatgattagtttgaattctcccttcctctcacagaatgtaagtttcacgagagcagaaagtgcattagtgttgttctcagctgtttgctcaaggtttaaataaaaacttaaacatagaaacaaaaatttttctttttagttgtgctttctattttttcttgggaccctgatagacagaacagtgaaattcatcatctaactgaagattgcagtattttggaacttggcattaaaagcctgactcaattacactgaaggagattgtacatctcacagaaagcttggacttgagcactgacctccagacactacctgagaaggtctagtagacatgattttccattggagaggtggtggtgtttttgatggcatgtagattgtgactggcaggggcatttttggaatgtaagcatgtctttgagtatgtgctaggtaaaattgaagagtagattgtagtgagcctccactgtggttctgctttatgccaataatttttcttttaattttctattcataaaataatctgcattaggacttttgccaattcagcagaattatgtcattaatacaaaggattataatagaacataaattggctggcccatgcatgaaatccaaaataatatgagtattcacaattttgacaaagcattcaccttaagaagaggcaaacaagcagggaactaatacagatacagttaggtttggtagaacactgatacttgtgatatttatgacataatcatggttctttttgtcataatatggtattttatatagctatttacttaagtgactatatgcatatgaactactaacatttttcacattttctctgcccatatttgggctgctcaataacagatagaaatgttatagttaaaaagaaaattattggccaggtgcggtggctcatgcctgtaatcccagcactttgggaggccgaggcgggcggatcacgaggtcaggagattgagaccatcctggctaacactgtgaagccccgtcttactaaaaatccaaaaaattagccaggcgtggaaggacatgcctgtaatcccagctacttgggaagctgaggcaggagaatcgcttgaacctgggaggcggaggttgcagtgagccaagatcgcaccactgcactccagcctggatgacagagtgagactccgtctcaaattaaaaaaaaaaagaaaaaagaaaattattatctggctgggtgtagtggctcaacctgtaatcccagaactttgggggctgaaggggtggatcacctgaggtcgggagtttgagacaagcctgaccaacatggtgaaaccccgtctctactaaaaatacaaaaaaattactgggcgtggtggcaggtgcctgtaatcccatctattcgggcagctgaggcaggagaatcacttgaacctgggaggcaggggttaccataagctgagattgcgccattgcactccagcctgggtgacaagagcgaaactccatctcaacaacaacaaaaaaaaaaaaaaaaagaaagaagaaaaaaagaaaattgttacctattctccttagataaccctaatcttaatctagtaatactgtatcctttttgagaagatttcagctgtatcctttttgagaagattcagctaaaggttaattcagctaaaggttaacttcagctaaaggttaattggttaacgtgacatattacgcttaaaaatccctaaatgagtcgttttaaaaacctgtctttccctctaatagccagagtttctttgtgctattgtgttactttctgattcatccgagtgatgcttgagaatgccaggaaaacaataaaaacatttcttgccactgagccctacctttgcctggaactcagtgaacatcctccatgaggtggcaaaattgttctggtattagtttgtagtaaaatttcctgaattaggagtggaaaggaagacaatattatgtaaaactttccgtgggttcacaaaaatgaagtgttatcttgtgttcagatcccagacttagagaaaatgattgtgttttctttttcttttcttttttttttttttgagacagagttttgttcttgttgcccaggctggagtgcaatggcgcaatctcggctcaccgcaacttccgcctcccaggtttaagcgattctcctgcctcagccccctgagtagctgggattacaggtgtgagccaccatgcccggttaattttgtatttttagtagagacggggtttctctacgttggtcaggctggtctcgaactcccaacctcgggtgatccgcccgcctcggcctcccaaagtgctgggattacaggcataagccaccatgccctgccaataaaatgattttgaacatatagttctatattatttatagtgaacatttaatggaggggaagttctgccttcaggaagactatgaatattgggactgtgtccttagtagacttggcactaaaaaaaatcactcatttgacatcacaagattgcacaataaatattggagatgttggaaaggtacaggtacacaatggaatactacacattcgaaatgaagctgtagaattgaatttattgacaaagatgtttataatatatcatcattaagtgcacaaaaagggtaaactatatgctgaaggatagtttgggcagcaagcaaaagaacatctaattcaaaatgaattaaataaatatatttatttttataattatcataattacatttattaatctaattgttctagtgcagaggtaaaataggcttcagggtagactgattcagtgacccaacaatattattaaaaaacaatgttctttctgtctctctgctctgtaatccaaaatatctgctttatctcacagctagttcccccaaataattgtaagatagattccaggtgcaattggatattactacttgctttctcattcatatgctgaagaaagagagaatggcttgttattgctttctgcaaagaccaaagaggaaatttttgaagtctgtagccactatctcttcatttatcattggctagaactgctgatttctaaactgatagctggcggaaagaatgtgattatctttagaccagtcagactcacacattgagttaaaggcaatttctaaaatcagagtactgccatttcatggatagtagaatggaatgcatttggggatttggacacagttaaaaaaatctctatctaatctctctctatggatattctagaaaattaatattgtcatatgatagtatctggacaatgacttacatttctttttaattttcttcctttcactcacatgtatataatattcttctgtaaataagcatacattgttttttgtctctttaacattttatatggaaaatttcaaataaatccaaaaataaagatagtaataaaatgaaacctcaagtatccatcacccagattcaacaattatcaacttctggaaaaccttgttttatgcactgtttgtaataagaaaaaaaaaagttgattttagttaaaaaagaagttaagatctgcttaacattttctcttgtccatagaatataccttaaagcaaatcagtaaagtttagctaaggatagcccaatatttttcctgtcaattgcccaagatctctcttaaattataccccaagtatttttttgaaaatttggtttttctcagtttcttatcctacatatgcatctcaaaaatttggaccgcagtaccccaacatcaggagaaaagcacaaaactctaggagcttgtgtatatgaaacaaagtggctcactaaaagcatagttattttgaaatctcatttttagttttaaagtctgtatttttttttttttactctatctaccaatgtttaatagaaataaaatatttcaaattactcaccattgaataaacttgacactgttggaagatggtccatgttggtcttttggcttcttgtcctctgaggcaccctgacaaatacccctgtgaacacaaggtccccaatttaagagtcatagattatagttttcttcccttttaagactccccttttgatcgttgaccatatttccttgacttttaaacttcattctctttgaggactttgctttgaattcagtcctcttgttttttccattttagacctcctcagctcgtatgccctatcttaggattaatactcactttccagtcctggccaggcctggcccagtactctgcaagaggatcttggacctgtaagtcacaaatatcaaggtactcattcatttactaaatctttattgagtatcaaccatgtttctggcacttagctagtccttggggatactgtggttaaaaaggataaaatctcagtgtttaagaagactaaagacatcaggaacacaaaaaatatttaggcaattataaaatgggcaaataagtgctacattggatgaagtactgcatcctataaagcacaaagcagtatcctaagcagatgagggaagtcttccaggaatgagatgcagtataacaataggaaggaaaagtaagtggtggtaattttctatatttgaatgaaaacttactcttgctcaaccacgaaggatgttttcttagaaataaagggattgtcaaaagcagcattcagtatgggagcttacagtgatgtatctagaggggacaagcatgaagagtttgattactcgggagtgcagtttagaaaataactatgtttccttcacagaaaggaagtgttctgccaggcggagtcattgcttccttttctctcttcccttagtcctttgttttcttttttcttttgttttcttttctattttttctattttttttttttttttgagatggagtctcactctgtaactcaggctggagtgcaatggtgcaatctctgctcactgcaacctctgcctcccaggctattctcctgcctcagcctcctaagtagctgagattacaggcacatgccaccacaccaagctaatttttgtattattaatagagacaggggttttaccatgttggccaggctggtctcgaactcctgacctcaggtgattcgcctgcctgggcctcccaaagtgctgagattacaggtgtgagccaccacgcctgggccagccctttgctgtcatatcacatgtggaacatccctacctgcctctcctatgccttcctacctgaagaaataaattaatcattttcccttctaatctacaaactgtgtattatactgaaacacaatgatactttaaaaaatttaagaattaaattgattcaaattttattttatttttagattcaactgattattttgattacttaatcattaaaaaatgatactgttcagtattcagaaagtttgggttcatttttttctttcttgtttctcaataaaagaaatgggtagtggtagtgatgttggcatttgttctgaaagataaatgtgacatgatactcatttcctgcctggcgcggtggctcacgcctataattgcagcactttgggaggctgaggcaggtggatcgcttgagcccaggaattcgagatcagcctgggcaacatagcaagaccgcatccctaaaaaaggagtacaaaaaaaaattagccagtctcataacttggcctgaaaataaataaataaataaataaatagactcatttcccattgagtaatccagaaagagacacaccctgaatggtattgcctaggttttcttctagggtttttatggttttaggtctaacatttaagtctttaatccatcttgaattaatttttgtataaagtataaggaagggatccagtttcagctttctacatttggctagccagttttcccagcaccatttattaaatagggaatcctttccccatttcttgtttttgtcaggtttgtcaaagatcagatggttgtagatgtgtggtattatttctgagggctctgctctgttccactggttataggaattggcaaggacttcatgactaaaacaccaaaagcaatggcaacaaaagccaaaattgacaaatgggatctaattaaactgaagggcttctgcacagcaaaagaaactaccatcagagtgaacaggcaacctacagaatgggaggaaatttttgcaatctacccatctgacaaagggctaatatccagaatctacaaagaacttaaacaaatttacaagaaaaaaatcaaacaactccatcaaaaaatgggcaaaggatatgaacagacaattctcaaaagaacacatttatgcagccaacagacacatgaaaaagtgctcatcatcactggccatcagagaaatgcaaatcaaaaccacaatgcgataccatctcacaccagttagaatggcaatcattaaaaagtcaggaaacaacaggtgctggagaggatgtggagaaataggaatgcttttacactattggtgggagtgtaaactagttcagtcattgtggaagacagtgtggtgattcctcagggatctagaactagaaataccatttgacccagccatcccattactgggcatatacgtaaaggagtataaatcatgctgctataaggacacatgcacatgtatgtttattgtggcactattcacaatagcaaagacttggaaccaacccaaatgtccatcagtgatagactggattaagaaaatgtggcacatatacaccatggaatactatgcagccataaaaaaggatgagtttatgtcctttgtagggacatggatgaagctggaaaccatcattctgagcaaactatcacaaggacagaaaaccaaacaccgcatgttctcactcataggtgggaattgagtaatgagaacacatggacccagggtggggaacatcacacaccagggcctgtcatggggtagagggagggaggagggatagcattaggagatctacctaatgtaaatgacgagttaatgggtgcagcacaccaacatggcacgtgtacacatatgtaacaaacctgcatgttgtgtgcatgtaccctagtacttaaagtataataaaaaaataaaaataaataaaaaaaagaaagagacacacccaaccattattgaagtcctctaaggtggggatagaggacacacagttcatcagggctgaggaatagagaatgggaaaacagatgaagaaaggcctgtgctgaccttttccatgccctcccatggatgtgtttttcctgcacgtcaagttatttaagcaaaggattgtttttgtctggatttttttcttttccaacttcagccatttcttttgttctttttaggcatgaaacattaaataaagttattcttaatatgggatattctcccctaagtctttttagatgataaggaaacagcatgtccattccaatagcctgttcaagagttctacttttaataatttgtgtctcatacttccagatagtccacacatagggcaggtcttattatttcttgtgtatttcattataaccttattaggcccaaacaaaataagagtcacgaataggcaggaaaacatatgactgtagtaagctaggtgttgaacaggaaactgtggcttccagagattaaaatagttttgtttgtgatcttagaggaaacccaaaaggtgttcacttaggtctggttttaaacaggcagaacaacttattttaaagtaatatttctggtaattctgcagctactttgtagtgcctctgctgttctaggcattgtgctagatggtatgaggaattaaagatgaataagaacaaagtttccttcttaggagggaatacaatctaagttagcttttctctttatttatttatttatttttctgagatggagtctcactctttcgcccaggccggactgcagtggcactatctcagctcactgcaagctccgcctcctgggttcatgccattctcctgcctcagcctccccagtagctgggactacaggtgcccgccactgcacccggctaatttttttgtatttttagtagagacggggtttcaccgtgttagccaggatggtctcgatctgctgacgtcgtgatccacccacctcggcctcccaaagcgctgggattacaggtgtgagccaccgcgcccagcctgcttttctttattgtaaccaaaatcatttgatgacttccaaacagggcaacatatgtgtcaaatatggtcatatttaaataactatgccaaggttctgcagttcaattaacttcatttaatttggacacttctagtattagaaaaatatctttttttgctatcatccattaaatcatcaatatttttaaagattcacttccatctctctttttaagaatgaggtgttacataaaactataggtaaatgaatttgaaaaagaaagcaagtaaggctgagtgcagtggcttaatgctgtaatcttagctctttgggaggccgaggcaggtggatcacttgaggtcaggagttcgagaccagcctggccaacatggtgaaaatccaactctactaaaaatacaaaaaattgggtgtgttggcatgcaccagtaatcccaattacttgggaggctgaggcaggagaattgcttgaactcaggaggtggaggttacagtaagctgagatcgtgccactgtactgcgccactgcactccagcctgggtgacagagcaagactctgcacccccacccccccaaaaaaagcaaacaagcaagtgcaagtaagactttgtatctctgattagatgttgaacagtgaatgtctcttcccagacaatttagataatttacatacattctttctctggttagccttacagattaaaaaatggtggctttttaagttttaagttgagtgacttatcaaaaatactttaagacttgaagaccaccagtctagaagttagagatgaaatattagaatatggcagtaaacagtccagcctatgaactagaactagattgactgggttcaaatctcagcttagccacctactagtatgagacttgggttaagttaaaaaagcccttgtatctcagttctcttatttttaaaatgctgataacaataatgtttgtaagatgttgtgggcattaaatcaataaatatatgtgaagtgcttgaaaaaaggtatggcataggcaaacactccatagagtgtcacctattatcatttttatgtgagtgtgggacctgctatccaatgacatcagtagtctcccactgtgacataaaaggattgcatacaaagaaatgcttaataaataattcattcgttcaaacaagtatttttgagagcctgaattctagattctggggatagagccaaggaggacaagctgaagttctcagttttaagggactttcatctgaatgaagtaaactgacaataaacaagaggaacaaatatacataaacatattaagcattactacctactttgaagaaaaagaaagcaggctaaagggatagagactaataaggaataataatgggcaagctgttatagatggggagatttacactcttttgaggagatgatatttgagcagagatatgaatgaaatgagagtgaatgctgggaaaatcaacaggaaatgaattctagaaagtgggaacagcagaataaaggccaggaggcagaactgaattcaggggttcaagagtaaacagaaggcccatcgtggcgtgaagtaagatctagtattcgaagatgaggtagaagtagtcaaataattttggatgaataatagatacatttaatgactcaatcaaaatgatgagacatcatgctgaaaggaagcttaagatacatttgtaaataagattataagatgttgagtgggactttttttgttgcccataattgaaaataagaagagctaagtaaccccctttctatgagaagctcttaatagatgccaaatattgaggccagacactgtccccacctactaaagggtatgttacgaggcgaaaaaaattctctcctaccagcaactagcacctagctctggatacgcataaagagaaaactggagagagaacagtgcaagtcagcagacagtgctcacagggaaaggttactcctcttctcaaggggaacagaaggattattatttttttcttgctgaagccaattaatgggagtccatcagagaatgtttagagattgtgtgcgagtttgtgggaaggaagactggcaattcatttctcagctggctggatggtaatttactaaacacaccagtccctctggagctactatggcggagcgggggcgaatgtctccgcggagttgtgtatttgctacctgaagtttaggactcacccctgaatccaaaacagctgctagtcttaacatttctgaaggagaggaaattgctggagtagcttatggtaacagagttagaaggaactgtggttcagagtttgttcttgagaggggttaaattccctcctttatccccatcctggtcttttgtggcccttggagcatttagaagatggtctcagaggttactatggctcaatgcaaaacagcatggtggtaaggaagggagcagaatagctggtagtgaggagacactccagctggggaagcagttaggggcatggtctgctgtcagggtccaggcttttctctgagggattcctcagtgagtgagggggcaaagcaaagacgaagagtgtctatagaaaaccaagcacaccaccagcacagatttctcaacaccaccatctgttagcaatagacaaaactggattgaaccagagaaaaacctaggacactttctcacgcagacatgtaactgattatgtaagatctctaccacctttgtcttctctctctgaccccaaaactagaggagttcagcagcggggagtgaggatggttgtctcagagtcagatctccttccaacttctctactccaagcagtcagcctcacagtttgtgttgagggcaaagaaaggtaatcatatttatgttagtttcacaatccaagttttaaactggacaaaaataaacttcaaataactgaaactggtagaaagttagaagatttgcactttgggaggccgaggagggctgatcacgaggtcaggagatcaagaccatactggctaacacggtgaaaccccgtctctactaaaaatacaaaaaattagccgggcgtggtggcgggcgcctgtagttccagctactcgggaggctgaggcaggagaatggcgtgaacccaggaggcggagcttgcagtgagcagagatcaagccattgcactccagcctgggcgacagagcgagactccatctcaaaaaaaaaaaaaaaggacagttagaagatttgctaggatattcattaaaggacacgagaataagacttgacaatcatgattggaagccttgattagaataaaaaatataactcttttgtatctatgctcttgttgagacacattacatgagtaaccaaacaatgaaacataacactataaaccacagcacatctatggagaaatcaaaatgcactaatcgaaaattataatttcgtgggacattttatttaaatgtaaaatttcatctggcttctcagttttgataaagtagagagtctgtcaattgcttctttcttataataaagtgagtcaatcttccttccatcagcaacatataatacaaattcttcaggcccttgtcaggaatataaactcatactttctcctattccgtttctaaaaaggtcttctaaggaagtaatatttaagaaagttcatctaagaaacattgtaccctttgtctaagtactttgaattctgcctttgaatcaagctagaccactggaagtatatgcacctgaccacaaaaatatatctcctttaaaaatctgtcaccaactttaacttcaaaattttattctcaggcttctttgaattatcataagaaagtttataaaattctcttctatttgttggtaaaaatattgctgatattattcaacgcgttgctcagtgtcatctccatatgagaaatttctccatcaacttagtggcaggaaaaattctctcttgatttgtttctttcttttaaataatgagaattgtgaaactccctaagtttcccttgttattcttgctatcggcaagttcaaagccaaatttgcagctctgtcagagcaagtctcttatacaatatgtacaatgtattccacttcggttttttcttgaatttgaaccttattttatcagtatattttatattttaggggcgttgtctatttgtaaagaaatggagtataggtaaataaatttggttcatgtgctaggaaaagttggttcagatgactgaaagttgatctcctaacatgaaattgattaatctttgaggtgtttttcaaagactacttgcaaaaaaaaagaaaaaaaaaaagagacttaaaatggcccccaaaatgttatcttcattcattagtttaatatcattaaccaggctaaactgtatattccaataaattgaacaataataggattattttaacattattactgtcagttaattctaaaaaccttatctttggtttttattatatgtaccattatatattgaaaagcttagcagatcctcacatcaatgtccagaaaaattatctccagcattatgaagacacttatatcagttgtagaacatcttatagaagaatagggaagagaggtaatattttgggtaagaatgtagcacaagcaaaaggagagtcagtgacagagtagtgacagcttgtctctaaatgctaattaattatattgatcctctttgttttctcagcttaaacaaaataaagtgcatgggtaccttcaaaacaacacatgatagaagggaatggattcacaaatgacaatagctgtgtttacctggacacctagttaattcactagtttaacaatattggccagtctgtaatgtacatcccaataaactgaccaataaaaggattgccttagcattatggaaatatagctaaagtataagtttaagggcttccataaattaatcagattattattatacataggcatttatgtattatcaggtataaaagacatttgttcaagctaggagatattcaaataatgataaaaatcatctatgactagccacctgggaactatacttttctagtttaaagccataagatgcctcattgctttgacattgctaagtataaaaaggactgtagaataatttgttggtgataaaaatgtctgtggtcacattgctattttacttattatgcaatgtaagatatctactgtggatttctaacagactcaagtccacaaatatatttctcctgactgttcctgacattgcacagaatggcacagggaacacagaccaacacacaaaaagaagagtaactctttgaaaacattttcttcacactgtagtttaggacaaaagtattgcagaataaaatttatggttttagaaaaaacagcaacaaaaatttgaatgaaagacaaacttttgctttttcgaacttttggaagacaaaattatgactctaatgtttcattccttcttctttccttgccattcaaatttctactaaagtgtaagatatatcataaaatttgataatatacactgcaatgcccattgagcagactgaacaaaggccattaatatagcaaggaagacatatttttaatatctttagtctgacattcacttgtcctttatttacatatgcgtaatctcttaattttctacaaattgtagcttatactcacagagttttaaaaaaattcatgatagccctctcattttctgtatctacaattctaggttatatattaccctaagtatacaggtccataggcctatataaagaatttatttgaatttgaaatcttgattttgtgaaagaaacaaatgtcttgagattttgttaaaataagtctggcaagtcttggcccaaagttacactgagagggaatctgttttcctttgaaaacaaaagtattatcaatattttcataaaatgtgagtataaaatagaacatagtattattaaaccatattaacatttcattggcagagatttcactttgttaaaggctgtataagaacagcttaatctcataacccagaagtttttactgttattattgcctctttatttttggctaaagtgtaatttttaaatgagtatacagaaacctaatactatatattgaatgactttaagtaaataaatatccatgctattcatcaggataagtgacctagtgaccagaataaaaaggatatatgttggtagcccctagcacagtatgcctcagcacagaggtttcttgggttactgctagtgaatgattccaattcttggccgtctgatcccacacattacataaattccaactcctgcatctgtttaggtgagctgttggctaaatggatatgtaatgaaattaaacaatatttttaaggtgctttttaggatgggttataccccctctttttctcctcctttccttgcaacctgccctctactcattctttttatgcatatttttgagagcctgaatatgctaggaagagggtttcagtctgttaagaattcacaaccttgtggagttgagatacaattaataaaatttctagtataatgaggtaagtattatgataccatgaaagcacagaggagaaacacctactctgttttgtaaggattagggaaagcaatttagagattatacctaacacaaacacacagatatttgcatagtatgtgagcacacgtttaaaaaaatgtaattttcaccctagaaataagacagtagtgattcagcgtgagttgatatgcctgtctccactataatgaaagaaatataacgtcttaagtatgggttgacatttgcaaactaactgatttttctagaagaatgatgccacataatttaaaaatattaatgcttttctaatctctagtgtattttcaatggctaacatagttaaaaccaaagtgaaatttttattatgtacataatcgaatgcaaattgtgtcaggctagtttaaaaaatatgaatgtcagtcctggcttggcaatttaataactatttggtttttgaccaagtcatttaacttaattaaacctcagtttcttctctgtaaacaagagaaggtcaagcaagatagttttaaaatttctttccaaatttatacgtctgacttttctaaaaaatctggtttacactaatacttaaaagaaattatcttaaaacaataaattataaatttattttttgctcttgctccctgtaaaatttgtccttgtcctgctagtcacatatagtccccactacaccagccaagacttgtcagactggttctgttgagatcatcagtgacttatttcctcacttcaattcagcccacaaagtcattgatagagctggattcacacacttggatgtagacctcgaccttcacaggactcttcattgctggttggcaatgatgtatcggtgagttagttccctttttctttctagaagtcttaaggtaacttttagtttaaaacagtatgagccacaccaaggaatgtgtagatctacagtttattatttttttaaatatagaaacatatttttgagattttacataaaattatgtcaagaaaaagatttctattctttctgtattagtgtttcctgtcctcttttgttgtatcccatgtgtttttctgtttacttttagaaggtttctacacaatgtaaaggtacatggtgtttgacagctgtcttttagttagtttggccatatgtttcaagaaagatataacatatttttagcttgggctttgtttgtcttattgagaaacacttttattttagaaggtgtacatgaaaaaaagtctgaaataatgcagaaaaaaatgtttatttctgtaagtagttaaaaatttaaaaactctagatgttttgaaagaatcagaaacaactgaagaaaataatatgactaaattattatagcctgatttaaaaaataaatccactgatatgcctggccatagtcaacttctccaaagataagtcatgatcattttgaggttttctttcaaagttagaaactaatcagtaacaaggttttggggtactagttttgtctttgaaaataattttatctcctgattaaaatttattttctctgattctcatattggcatatcattttttattagtttttactttgagaacagtttgaaaatgttaaactttgaatgaaatctgtggtcttcatttaacatggaaaaacaggttctgtcatcagttgaaagttctacatacttgttattagaagtttaatactcttctgtacatatccatgaagcaactaaaagctacggatactaaacattttgttgggcttatcaaggctccctgccttttgcaagtatttctttacaaccaatgatggttttgtatcctattctctttttctcattgactttactatagaaaacagtgcttcaagaaagcttccaataaacttaacatactaaatagattacaagccttatctatggtatatgtcagagatttggaatttggttataaatgtgtagaggcggtataatgtgggaatactggagtgaatttttctgagtgtagtctctaatttgaagcaaaagatgtgactatttttaaaaatcctgctgcagaatagatgcaaataatctctcatggaaaaaaccaaaaaccaaaaccaaccatctaacaaacaaaaacgtcttcctgatctgaagattgtatgaaagatgaagcacatctatgtttgagtgggtctagatgagataaaatgttaagagcatgtactagagcaaaaaaggattaagtttattattcacatttgctgtcgtaaatgtgccaacaggagtgttatcgaggaagagggataattgaaatcctaggatataagtagacaatttcttcttaaggtcattggttttaactcagaaagaatacaagaaacaggtggggaattttattaaatagcatgctccttccttttcagtcagatttcggatagccttctccctgactctacctgaataagaatcagttttttttgtttttttttagaatttaagggtaggaaaaaatttaaactgggtaagcattattcttcttgtactgccattttctccaaactcttattttggactattctttgagcatgaagagatcaacacatgaattttataaacacacaacagaaagttaaagaaaactctatcaggcataagtttatagagaacagatttgggaagagaagaatgtgtccattaaatatatttattggtcataggggtgtatactaactgtatttatcagcaaccactgagaagaagtgaaaataagcagactgaatttataggcatcgacatccacacatattgagatggctgaaggtgaaatgagtaatattcaaatgagacaaaatggacaactttaatttttacctaatagggtaagcactgtctctaaaagtgtggtccgtagacccctgcattacagtgcttattaaaaataggaatctccagctctcatcccagaaattctaatgaatctctggttgagacatggaaatcatatttaaaacatttacacaatgtaattcttatttaccctaaagtttgacaagcactaatggtgtaaagacatagaaaaagaaaaagaaatgtgtaagcctgaaagaaattaaaccataaatgaaataggccagttgttaaaagtagttctgttttatttaaattggtgtaattacatcttaatgggaggtgctctttcccagtcacctttcccttcaagggagaagagtactcatttatgcaacatggtgatgattaagaaagagaggataatttcagaaaggaggggaaactgaggggggagaacatagacattttttgcttagtttgtgtctgataaggaagatgactttatatggatcataaaaatctatttgtttacaggaaaaaccttggtataaaattaatgtagcagtgttaccctgtgacattagtcagtatggatactgaagagacactccttttaggcttaggcccagagttgctatatggttgtgttataagtatttagcatgtgctcacacttctccttcaactagaatcagccctgatccatataacaacttttagtgagttctcattgcatactaagtcctgtgtggaagaaaactctctgttgagcacctactatatattgtgtattttataaaatgcaatttcattaaattttggtaatgttttgataagtggttattgctttcattccttttaaaagatgaagcacctgtggctcagattgtctaggcggttagtaagtgtcgaatctagaatctaattctgatctttctgattttaaaatatacttttttccctgtaacatattgtctaccatgtgtaggaagctataagtagaatctttgagaagtttacagagaaaatagatggcaacagagaaatagaaaataaacgcacacatatccacacatggagaaaatgttggtgcatagatttaaaaaaccagaagatgtaaagactaatatgaaatcatgcacatttatgctgaggaaagaagtgtggaggtgtaattttactttcatttataagttttaaaaacattttaaaaaatgcattgcctgcccttatacaaccgactttgtatttaaactaaataaacagtgatctatcttttctgcactgtttcaaaggtgatcagagtatagcactttaactacatcatctctgttttctaaaaaggattacatttgctatattgtgaaaatcatgtttatcttagagcaatatttcatggaactaattcactggtctgcagtagctgtctgctaaatgaatctttgttgttctgtcattgttgtctgctttcctccaaaaatatgtcattgcttcaacttaaagagaaaataaatagaaacaatccagagaaacatgaaaaatagcagtgtcgtgtgtttccgtattagcactgagatttataagcatgcctgatggttttagtgcttgtgaaagaggtagattgaacagtcgtgaagcaggtcttctggaagggtaggaggtaaaatgggttctctggcttgttttatggctctatcagggttagagtttagagaaactgcacagagaagttcttcaagtgcgctcctttggatctgctctcattgaagataatagctaagaactgtgaagaatactttcacattttcaggttttaataggtttaaaatgactggactagagagaaggaaggttttaagaggttgagaaagaaaaatgggctgcagaaacactgagtcatgccagaacctgtaagcccaaccttcttctcccatgtacacacatggcctgtgtggtagggcaatttttagaattgcaattctaagatgatagaactaatcttagggggatccaaagtactatacaggcatatttaaattctattttgcaaccttttatctgaaaatgtcagatgatatctctgttttgaaactgcaaaagcagacacagagggatttagcactttgtttaaagttgaactgtgagtcagtgcaggacaaaataataattgctatctttagtttcacatgtactatctgccaactactgtcttaaaacatcatatgcatttaaactttatatcaacctatggttatattatcatactcattttacagatgagaaaaatgaggctcagacaggtaatttttttttgcccaggggtaataataaaaggcagaactgatggttaaccagggtctatctgacttcaaagcctatgctcttaatcacagtgctataccaccctcacaatgtctcctttgtctgcctaagtggttcttttactactttgatttaactgacttactgtcttaaaaggtgaaaaatttacattttcaagaaacattgttatggatgatctttaaagtagacctctaaggccagtggataggaagcattgctgtatgcattctctaaaggaagggaacaaaatgctcaaagatgagataatttgcatgtggccacaggaatgggtgagtcagtcaagacagagatgtagtctgtcctcccacttcacctgtatactgatgtcaatacagtcaaacagaagagttaaattaacaccggtggctacatgacccaagacatattattgttatttttattactattaccatttaagcttgtatgaaaatatgtggcccatttaaaattagttactttacattaaattttgtcaggtcacagttagtaaaatttagagagggtacatatcgtaacaataaaaatattatttgacgtaaatatgctacatatgtaatttcaacatatgttttctcatttggtactttacaacactgagaatcagataattttaatattaccatgactttacagctagggaaaccaaaaattaggaagactgagacttccaaatctctgctaagtgactggtagagctggaatctgagcacacctgttctcacatcagccctgtgctttctagtcctggcttctgccaggtcatgattctgggatcagaagtgcttctttggtgaagcacagataacttaccttggctttcaaaaaattactttatcttagtgtttcaactttcctaattcagaaaataccaaagataataaatgaacactttaaaaatatttcaaaccaatcttttaattatatagtacattcaagtcattattaggcatttggggatacattatttgattcaacaataaagctatatttggccttttaaaaacagggtaatgaattcttgtactaaactgtaggacaactggcagctgcctgactcaaatctctgaattggatgggtccgaagatgaacgctttttaaagttttctttactagttgaatccctttttgcactggaagcttaatgcagacccttgatgtttggagcagaattgctgtgggtggagtgggatagaggctagaagcttcctctaccttcctgtcttttattcccttaggcatacgtgaggcatctgagtggatttttcaacccaccttaaagctaatttttcattatgaaagaggaaataatgacaatggccaacttttgtggtgtatttactgtgtgcctggcatggtgccatctcccttgtgttactttatttaatcttcagaagaatcttctgagttaggtcttatcattatctccatttgtgggtggggaaatgtagatttagagaaggtgagtaactttcctagagccacctaactagtaacaggcagttaggactaatcccaagctgtttgatgcctaagcccaagtctttatccactaaacaagaaaatggaagtcatttgcttaaagtcatagagcttgttacaaagaggctcttgactagaaccttggtcttctgatatattaatattataattattaattgtatctcaaaattatgctgctagagaaaattaagttaaaatagtttaccatctttcacatatacagaatttgcaagagaattagtaaatacacgtcttcatgtcctcttttcccaaagatcattatgtgaaagtggcaatttcccttgattgcaacaatctgttttgcatattataatagtatcggatttagctacgagtgacaggaaacccagagtaacaggggattacataaaatggaattttattccgtttaatgtgaaacaattctggagataggcaggtaagagctaatagggaggttcacaaaataattaggaatctagtctcctactattgtgctgtcctaccagcttgattacgtgtcttccaaatcctggtctactgtggcaatccatgcttcaactagcacatatgtattctaactatgaaatgcacattaggattccagccaacaaaatagagactccattggaaagaaagtattcatatgctgactcttatggacaaggggcactatttgatttttctggtggctgtgtgcctaaccaaagatcaaggtttctgttattagaaaaaaaagaataaatatttgggataggcgtctaggagtttctagtatagctgtattaagtttgaatggtaagaggtatagcccattgtgatgaacataggctggtggatatatagttttgaagtgtaggcaagtgagctgagctgcagttatagatttggtagtcatcagtatatagatatgaattaaacgcatggacattggtaactaaaagtatttgttcttttgggtaaaataatgcatttcttataatttttatggtattaatttgcacagaaatcctactttattctaatatgaacctgagcttatttcactatgttattattaaatgccaatatattagaacgtaattgtcaaggtgagtatataataaaaaatttcataaattttatgtaccatccaaaaattaaaactgaattcttacatatatttcaggtcgataactggggcagaaaattctttaatcaggaaaactcacttttcattttggaagaattatttaaacatcgagagggtctatacatttttcaatttctcctcattgctgaattaattcagatagaattttgttacatgtagaaatttctagactgtctaaagaattcttggtgtatggtttagagtgctttctaaggaaacagcaagccagaggacacaacaaggtgtcagcatgtggcccaactgtcacattcaggcacattttaatcagggtctagagattttaaaaagttggtgtatagtagttatacatattttgggggtatctgtgatattttgatgcttgtatgcaatgtgtaatgatcaaatcaaggtaactgggatgtctatgaccatcttgtgttggaaatattacagttctcttctagctattttgaaatgcaaaacaagatattgttaactaaaatttccctactgtactgaatggtagaacttattccttctatctatacatttgtaccccttaaccaacttctcaatacaagtagtaaagtatgattttcaaagtctggctttctcaggtatggtatttagattgtttcaaataacttgtagtctcttagtttgactgcaaattatttcaaattatctgacattgtagtcaacagaaaaatgaggcatttgaaaaattgcctgaagtctgattgtttaacaaatgctgaattttaattaggatatgtaactttttgtgttatgtgaggcatggaacattagcttggatgaaaattgaagaccatttagatcaatttaaatttccgctgattttttaacatgtgaagaaaaggagagctctcaatatcatacaagttggggctcaggggatgctggaactcgtttgatgtggagtatgctctcagatttctcatctgtttgaactaacactaagacataggttactggttttacagtttagatctacttccattctatcatgcaaactttcttggagtcatctagacaatgtcaagaagaagatttggtaggaagacagctaaaattttaaaaagtttctgaaagtctcaagctatatattagcagccacaagagtgtctctagctcaggtttctcaatcatttttcttctgatacacttgcagtgatatcagcacactgcttgttaattcttatttttcttccacattttgaagtgtgtaaaattccctatgattggctgcaatggcatcgctcgttaactttgctgtgggatattgttgtgtataaagttgctcaggtaatgccagtttattatcttgaactaaaaagagtttgaggaaaagaaagcaaatatattagtagaattcaaacttcagtagcttagtttaagtctataaacccataactaattacttaataatatctttaatttttttgcaacccacctatctgtatgtagttgcaaatttctagagatcaggccaagtgtcaacttaaatatcagtttgtagtcacctgtgctgtaccatatttagttgggaacttaataaaaccttgatgataatcacagtggaggtcagagacattccttactgttgagttgccactaatatttatgtagtacacctatctaacaaagtctattgatatcatatgcaatcttcacaacctccttttaaaggtaagggaaagatactgtcacgtaagttttatggttggctaaacagaaatagttaaactctgggttttgtaacttctctatgagaactagccgtaattattatggtagggaatgcaaacattgtgattcagcccaagcgcctggctgatgctatcagatacttatagatgtgttttatcttccagtggataggacagaaatatgttatttgtaattttatgtggagtaatttgcttgtatttcttctttttttaaaaaaacagcaatgaaaatatataatccatgcacgtatatatgatattctgttttatttctactgtggatatttttatagtcctgttctagaaagtgtgagaaggattaattatgtcaccaatgcttgctggtttgggcttttcacaaagtaaaacacatctcaaatacttttgttgataggataagcaggcacaatcctatgagctaagctacggtcaaatacatatcatatgccaaaacaaatatatagaccaatggaacagaacagaggcctcagaaataatgccacacatctgcaaccatctgatctttgacaaacctgacaaaaacaagcaatgaggaaaggattccctatttaatcaatggtgttgagaaaattggctagtcatatgcagaaaactgaaagtggacctcttccttacaccttaaacaaaaattaactcaagatggattaaacttaaatgtaagacctaaaaccataaaaactctagaagaaaacctaggcaataccattcaggacataggcatgggcaaagacttcatgactaaaacaccaaaagcaatggcaacagaagccaaaattgacaaatgggatctaattaaactaaagagcctctgcacaacaaaagaaactatcatcagagtgaacaggcaacctagagaatgggagaaaatttttgcaatctatttatctgacaaagggctaatatgcagaatctacaaagaacttaaatttacaagaagaaaacaaccccataaaaaagtaggcaaaggatatgaacagacacttctcaaaagaagacatttatgcagccaacaaacatatgaaaaaaagctcatcatcactgttcatcagagaaatgcaaatcaaaaccacaatgagtaccatctcatgccagttagaatggcgatcattaaaaagtcaggaaacaacagatgttggagaggatgtggagaaatagggacatttttacactgttggtgggagtgtaaattagttcaaccattgtggaagacagtgtggtgattcctcaaggatctagaaccagaaatactatttgacccagacatcccattactgggtatataccaaaaggattataaatcatgctactataaagacacatgcacacgtatgtttattgcggcactgttcacaatagcaaagacttggaaccaacccaaatgcccatcaatgatgtctgttatacgtatctcatttcttcttcaatgatagactggataaagaaaacatggcacatatacaccatggaatactatgcagccataaaagaggatgagttcatgttctttgcagggacacggatgaagccggaaacatcattctcagcaaactaacacaggaacagaaaaccaaatactgcatgttttcactcataagtgggagttaaacaatgagaatacatggacacagggagcagaacatcatacactggggcctatcagtgggtggggggctaggggagggatagtattaggagaaatacctaatgtagatgatgggttgatgggtgcagcaaaccaccatggcacgtgtatacctatgtaacacacctgcacattctgcccatgtaccccaaaacttaaagtataatttttctttttttaaaagaccaactattgattggtggtattgctgtgaagaggcttcttctggtaaatttttctttgaaacactgagccttgacttgtcattttccagtgcttgccattagctttatttgcactagtacattttccccttgtctttttgctgttgctgctgcttttcttttttagcactattctaaaaattacacattaataagcaataataataatgcagcctaagcatattgcttgttttctggcaatttggggctaaaaaaacaaagcatactttaactgttatattcacttgacttgtcactaattatacatgtctccagattgaaaagaaaatcatataaagaaagaaatttgatattactaaagctgttagaattcaatcagtctatctgaaggtgattttacacgaataggtgcacataagttttgatagatgaaaatattgactggacaagtgtttatgtatgttcaggaggaggttaattatacaaacgtctgttgatatgtaaaataaatttattccttcactttactactttctttgagcatacttttttcacatctaatttggaggaattcagtattgaatcacttactgagaaaataaaaaagtaactaagaaataggatcaattatatctcaaaaaagctaaaaaatagggtgaatcagtttgaaaaacaatgctatacagactgggaaaagaacaaataatgtttcaagtgacaaacatcttagtaatgtggtcattaccactattactaataattaaaataatgatgatgataattatcatcctcgttatttgtacaatgatttttccacttgggagctcaaagtaccaaaccgccttctcatttttatctctacctagctcattaggttaggaggggtctggacttattatccttgtttttcatatggagaaattaagacagataattgaatctctgcgtacaagactatataataaatgagttggtggcagggctcagaaatataatctcttaattgtttattcaaagtatttttgactggattctctttttcctttgtcccatattatcccttttgtctacttctagccactcaggagagcatgtcactaaaatagttgtgagtaatgtggaaaggtgggggtcagaagaagaatcacagtggtaccttggacactgcagtgatgtaaattccatgaaaatacatatataatcttccttagtttttttttcatattttaagaatgtcctatgtctctcgctctcttttttttaattcaaacgccataatgttgttcttaaaaaatccaccataaaacaaacaaatccataaattaaaattaaaatttctcacttatttgttattcggcttcttactaataaacattggttgtgtcttctatatattttgttatgcacacacatatatagtttcattatttatgaaaaccgaaacatgaaatgcatattattctataactttttaaaattgaaacttatcattaacctttttaatgttaatacatgaaacctacttcatcaatagaatggctgcattgcttacatttttgtcttgattaaaacttactgtagaacaaatagaacgtgtctaatatttcacaattctatataacaatcatatacttttgataatttcatgttttctacaagcacacattcattttcttcatctgacatgttttgatattagttgagaaacccttctctccctgtattccccccaaagttttgcttacgtgtgttatacccatctcctttcttctgtaacagattaatagcaagcattcagggatgaaggaagaagagtcagttttgggggtttcttaggctcagttgcacataaaacataatctcattgtggagaagactttttatattgcagtaattgacattctaggaacaggtgtttggaattctactcaagggaaaactggagatgggaaaggttgaggagagtaagataaaagcttccctggttacggccccgtggaaaaatcacaggaacaaggcaggagaacaagcagagcccctggagccttccactacatctcagtccctttcccagggacaggattatacagcgatgataacaccattgacttctatgccaatgctctttattttgtgtccagccagagccaggatctaatgatggtgtgacaggggccaacatgataatattatcacttcctgatcctatatcatcaggaaacagagcgttcttgttttctgtaaacaaaaggcatttattgtgaaatgctttgctgtttacacgttcatgatctaattttaggtcccaaagtgctttagacggaatggttatcccgccccttactgatatatggggaaattgagctcagagtttaaatgatttttccgtcgctgatctgttaatgaaagggctgcacttagaattctccttattctgattcaacacccagtactcctccaggagaataccatgttttcctcaagtcctcatgtagcagacagttagcactctagaaaaaagaaaaaagcatagcacacactggcgtaaatacctcaagaaatctaaaataagagtatcatattcaaactccttagtcatctctgacttattatttcacatttctggctttagagtttgcttaccaaatattataacccaatgggacagcaactttaccaatcaaacaaaaatcatgtggatcaatgtttttcagtaacatgtatttttgaaggcagaacaaatagaagttgagggaatctcatgcaaaaagaatttcctgtagctttttttttttttttaagacggagtctcgctctatcgcccaggctggagtgcagtggcccgatcttagctcactccaagctccgcctcccaggttcacgccattctcctgcctcagcctccagagtagctgggactacaggcgcctgccaccatgcccggctaatttttttgtatttttagtagagacggggtttcaccatgttagccaggatggtcttgatctcccgacctcatgatccgcccgcctcggcctcccaaagtgctgggattataggcgtgagccaccgtgcccggccttctgtagcatcattaaagcttaaaggtaaatattagctcaaaacctcaggttctttaggaaggggcctctggttgtttcttctatgtatcctcaaagtttggtttggaaatagatcagaaaattagaagaatagaattagcaactccatgtgaaacctggtatgcttcaagctgtaacacacttcaaaggctatttaagattctagagtgctagagaaaaggcttaaaatatttttgtagcccctgcagtgtctaactctatatcaagtacatggctggctcaacaagtgatagctaacatttaatattgcacttttctacatgtcaggcattgttacaggcactttatatgtagtacttcatttaatcctcacaataatcatatgaaataggtactatcattatcatcttccttttatggatgaggaaacccaagcacaaaagtcaaactacttgcctagcaacaggagtcagagtcaggactggcctcagcagcctggaaccagggtgtgctctaaacccagacagtacacgaccctccaactgaatgtcctttattcccccaaaatatctgttttgtctaatgagtggatgtgttgcatgctctgaaataatctatctatttattttcttccttaggccagatgtggtgagggctaggaaaagagtttgttgggaaccctgggttatcggcctcgtcatcttcatatccctgattgtcctggcagtgtgcattggactcactgttcattatgtgagatatagtaagtataagctgccttggcatcatgtgatttaccccaaatatttcctcataccttgctgttttgatttgcctcaggcttattcatttatcactacgattcatttgcatagcctgtacaaagggatctttacctgctttctctcttatttagtcctcataagtcaaggaggattcttttttctatctttgatgtagtgatgctttctgctgggaacagcatgcttatttgcatcttccttaataagcaataagtgagtattaatcaaaggaaaactacaggatagctagaaccaatgtcttgagttgtttgaggtcacagggcaagcatcttgatttaaaataattctgaccgggtgcagtggctcacgcctgtaatctcagcactttgggaggctgaggcgggtggatcacttgaggtcaggagtttgagaccaggctggccaacatggtgaaaccccgtgtctactaaaaaaaaaaaaaaaaaaaatagccaggtgtgatggtgtacacctgtagtcccagttcctggggaggctgaggcaggagaatcacttgaacccaggaggcggaggtttcagtgagccgagatcacaccgctgcactccagtctgggcaagagagagagactcggtctcaaaaagaaaaaaaaaaaatccaactcgttgaagtcctgacatcccaataaatcaatgacacaatctggagtcataaagaagtaggctctattctgtaccagtaagttacaaaaatagtcatagtgatgtattgttgagtaagtgcctatttctgttattaaaatctcatcttaggatatattgtaagtgattaaagaggatagggtatgccaagaaagctaattataaagatgttcaccctgcggttatcaggtacctcattgctagatgaactgttagttgctatgttattagaaaggtctccagggtacttcagaactgttattctgggatgtaacagcccttctgaagtttcctcctactctgcctagggttttaattacttgactcaaccatgacctgttagtttaatatcttcctctgttactagattatacttggatgttcaaggcaccgtaaccatagaagctaataacttgattctaatttaattgggaccttgttgaagtttctttccagtaacgagaaagagtactctgtaacctggttatcttcctctactatccacgcaagtataatctcaatttacaaagcaaggtggatcatttctggatagtttaaaaaaatatttaaaacaaagatttttttggtagaatttgcatacaggcaagtctttaaatttggagtatctgcatattaataacagatttttctgtagcacactttttttttgctttttgagacggagtcttggtctgttcccaggctggagtgcagtggctcgatctcggctcactgcaacccctgcctcctgggttcaagtgatttttgtgcctcagcctcctgagtagctgagattacaggcatgcgccaccacacccggctaattttttctatttttagcagagacagggtttcaccatgttcgtcaggctggtctcgaacttctgacctcaaaagatctgccttccttggcctcccaaagtgttgggattacaggcataagccactgtgctgggactgaagcatactttaaataaaaatgaattgctggaataactttatagttctacagttctgctgagaatattgagtcctactttgttgtaagcatcattatttgtccccatggatgtctaggactgttttacacacttttgtgtgtctagaatttatcagaatcttggcacatgttatgtgctttataaatatttattaaatactgaatgataatatcaaatgaatcatgcctacaatattttcttgggccatacttcggcttgtctgacttcacaaggaattcctagtaacactaggggctaatcacctcagtgagagaaaatgtccctttctacttctcatttgcctcttcccaagccaagttttataagattcataaatcttagtcatatgtatacagtgaaaacttggcaagaattttttcagtaacctgttcctgaatcctgttgtttggatgatcaactgagtaatactgaacacacagcttctactgcccacacagtacacctgaataaacagtgattgttgtgatgtgtgttactgccttctatttgtgacctgctttctgttttgggatgtaaactaaccgagtggctttggcagacaaatatttagaagctgacatgccaaaataaccaaatcaaaccaaaccaaaaaaatctgtcacagaaatagacagatacagacaaaggtaatcagatttggaaaaatatcattttggttctcatttcataaagcccaggacaatgtagaattctgtgtatggttcgtgtctggggcctttgggggtgcatttctgcccctgtgtaatttggatgtcagaagatgaatctgttataagcaacatcactgcagattatagaatcacaaaactgctagaaatttaccaacaaactcatgtttatccttatttttaacttttctgttaatattcccaacatattttagtaactactcataccatatatttatggcagctggtaatatgttttaacagtggcatgcttaagtctacagggtaaagtaaaatactgagcacagataataaattgttaacttggttaaaccatatgaaattgccaatatttgactatttttgacctgtactaatggtgattttaaatcattcaatctaataagccaaaaaactacatttaagggtgtagaagggtctgttagcattctgtctagaatcttgctatttaatatgtgattagctaccagaagcatcaacatcacttgctagcttgttagaaatgcaaaatcttgagtctaactttagacctcatgtaccagaatgtgcattttaacaggctccctaggcagttcactttcacattaaaatttgaagcagaattctagaagaatggatacaactccacagagagttatagttaactatgaggcagatgttaaaaaatacaaatgtagtagaacagtagtttacagagatagttatgagttatttcccagtatttcaataaatttaaaatcttacttgaagttatgtatatttccaggtacctgcctgaatttcatgtcaccctggccattcagagaaagggaggtgaggaaggatggaggaagagtaaaacctcccaagtccttcacttaggtctcttgtactctggtgactcaactttcagtgtctcctgcctgccattcatctcttttattcatcaccaaccgcacccaagcccttgtcagagtctgatggctgcttccctctctgtcccatcaaatcctctggatggccagggtgttttatttgaaatacaccagtagttttttgcataacttttatacaacaaaagatttgtcctctagctttaataagtggctttttttcctactctaagaagcagcatgtgaagtaagtgggtactttgggagttagtcttggctatgtcctgctggacttgggcaagttatttacatttccaagactgtaatctattaaatgtggataacattgccttttcatggagttattgtaaattaaatgagatatgtgaatgtactagggacactggtgtccagtgttagtttccttttcttctgtggtttaagtgaagagggaaagaatagggaggaagagaaaggaggagagagactgtgactggatgagccacagtctgctttcctatagtaactatatacaactgtcttgatcaccagtgtatttctaatggttgacacagtgtctcttcctgaaaagtggttggcattaatatttgttgaatgaatacattaattttctgagggctgtctgcttgctttatgcactggagggtagaggaaaagttatatcacattaacttttcagcaggtcaaaaatgtgggttgcttaaattgaatgcagaatgtagagacagtggctaaggagcagacaagccaacccctgtggttggtgggaaaaacatacatgcagtgacaaaggacccaggtgaaactaaatagtgtccctggaaggttatgccaggtggcaactttagctccctaaacttccatttactgaatcccttgcattttaattcctaacctcatcttccttttcagccaaaataaattttctcaaactagagttcttgcggccagaattgatgtatagttgatggaagggaaaagaaaatctatgtttggaatataaaaatgcagtgacccttgggaggcttctgaatccatccctgtttgtatgctcagatggcatgacttgctgtctcttgtggcttacttaggaatgagtaacacatgaataatcagcccactgttccaatgagctacttgtacagtactccaggaacaccaggcatttcttacagcttttattctctaaatcacatgatgataaatgttgttgttttttatcctgagataactatgaggcctggggcaggatgatgatgatgacctgtgctaagagcattccttcctgtttcagtcttccagcaaccaccaagcggggatataatgatgctttacacacatctgataaaaattatgatagtgttttgcttctttccttgtagatcaaaagaagacctacaattactatagcacattgtcatttacaactgacaaactatatgctgagtttggcagagaggcttctaacaattttacagaaatgagccagagacttgaatcaatggtaagcaacttgtcatctacttctagtgcatttgctttcactttttaccatatttttagcatcctagcttctaaaagatccattcaactaacggatccctgtgtatttgcaaaatgaaaagaggccctaacccaaggaatataaaacaaaatggacaatacatcacttagcacaatatgactcacagggttgaaccaaagaaactttagccattcggtcaggtccttcttactcacctttccttagctagtgatatactcttgatcagtagagtccagagattctggaaatgtgagtgtggcttaaaatatatttgttgtatcctagacttcctaaaaaagagaccccgagcagaagattgccaagattgaaactatttaggcacatacctaaatagtctgttaggttttaaaaatatctaaccttcaaccagcttttggtatataaatctgtagtaaatccacagatatgcaactctacccagtttttaaaaatatttaaccttcaactagcttttggtatgtaaatccacagataagcaactctacccttaacgcatcaacattcatcttgagggatcaattaaatacttaagaaactggaaaaattagcagcatgggccaaaagaacaagggcctaagtggtaacttcttgtcattatcagattaattaaagaataatttaacttttcctggaaacctgtgaggtaattcatgatataatgtgatggaaagaacactgaactgggagctgggaggcacatgtatctccaatggtatctactaggtaatgatacatcacttggaatattagtttatcattctgcacaaagttctgtaaattgaaaattaaggtattaggttagataatttccaaattgtcttccagttccaataacctgaataagaatggaagtgagaccctggaaaccgcccagtagacagaagcctggggatttggccaccttgctgagacagtggttgaatcctggttacatttgcacttgcaaacaccaaatcagggaaatatttgaccaggctcttctctaaggctaaatacatatgcaaaatgaaggaaatgaaattgaattaaaaaggtcaagaagagatgccactatttcccttgttctttgtgccattcattcaaataaattttatttaagtaaataaaatccagacagatttaaatctaaaggaatatacataaggctctttaatgccttcaaaattaataatagttttgaagttacttgacaaaaattaacccttaaataaaaattttcttgtgaatactgccatcctattcagaggacttctgctattcagctttgtctcataatcgcaagaagtgtccttagtaaaaaaattcggaattaataaaatgtaagaaagaattaaaaggctcattgcttctgttaatcaccagcatgtagtaagtgtttactaaatatccacatactggaaacaagacacctttgagtgtttccttacataaactcctaattaaaaaattaagttgcctagaattcttatttagaataataactaacgtctctacaaaaatagactctttcactttagtagagtaaaactcataggtgtgttaggctaagtatcccagttcacctgggcctttctaagagcacttggagtgctgaacttcgtgtacattatgccaggaaaactgacaactttgtcactaggtttgggaagcatttgacatggtcatgcactcatttctataatccaagtattatgtggcagaattatttcatttcctttgtctatgggcagtaaaagtccttacttcagagtaaaatttctcactcttaattttgaagaaacagcatgttcattttctttggtctctttctgagcattagtacagcagatatcacttctggccccactgcggttccctactcctatcattcctaagacagcgttcagttgaaatcactgagaaaaccacaatagattcctcaagcttcctcagttccactcactgtgaaatgtcaatgttttttgctctgttttgttttttaattttctaaaaagctttgaattaatttgtggaatttcagaaagttgttcttgctgatatattttgaatatttttacaaacaggtgaaaaatgcattttataaatctccattaagggaagaatttgtcaagtctcaggttatcaagttcaggtatgtaaatctgaattgctgacttctgaatttaaagttgaagctgttaatctgctcagcaataaatatgttttcaagtgttaaagatataattcaatccaacaaacatttgacacttgtcctgtgtaagtcatgggttacaaagtcccttattcattccttaaatcccaaagtaagcatttgcaagatggttgctggggacagaggtataattggtgcctatgttataaaattgttttctgggaaacttaccaagtacagatagtactaaatacagatagacctaacacacatccttggtttaatggcaagtagtgccccatgtaagacaatatagtagatcaggtttgtctttagctcttcttcctcctattaatcaatcttctttatcttcttctattccatccctccattctcaaaatatgtagctgagaaaatctcatctgtcaactaactattgataaatgggtttagtacataatgttaaggaaaatattataagaattttcaataagatattgacataatacaaattatttgtattaaaaaacagaataagaattatttccaatattattccaatgacaaaactttaaaagtttcctgccattctattacttagctgatatctctaaggcattactttgatcactgtcttctaaaaattctgtactctctggtgtttgagatactgccctttcttggatctgcaactacttctcttatctttaagtttcactttctcaaagggacctcattcacccacatggtctcatatgctattgaaatacaagtttctatctctagtctgaactatttttctgatttctataactatatacacatccccatgtggaagttccacagaaaattccctaactcaggaagaatccaatcacataaatgagaaacctggaagtcatcaaacactccttcctttcctggtcccctcatactttatgaataactaagttccactaattctattttcccaataactttccaatttgctcacctctttattccagtaatcttgctactgctactcattattctgtcttctgttactgcaatagtgagaagagcaagtttattggaaagatgaagtcaattttggagatgttgaatttacattctaagggaccatatgaacctgaaaaatgagggtgactcagtagagggaaatggaactgagcagaagatagaaatttgctcatgatcaactcaaaaatttggaagcatgggtgtaaatttctcagaaaaagaataataaaagggaatgaaaaggatgacaaagaaagcttgaagaccaatatttaaggtgatggaaggaatataggaaacttagatatagggaaagagcaggaaaatagaaaaatcatgacagaatcaccactgatgcaaaagataagaagtttcaaagagagtgtggtcggcattgacaaatattcctgactgagtaatataaatattgaaaagaatccactggctttgtcaactaggatacttgggttgttacttattttcgtgtcctgaaaatagtgttacaattaacatgtttataggtatgtccttgcacaaatgtatgagtgcatttgaatgtttaatttctagaagtggaaatgctgtgccagagaagacagatattcaaacttataatagataacactgccatccaaaaataagactctaatttgtattcccacttccagtttatgagagtagtggttgatgcaatatatagtgaagagttagattcagaagtgactatgaaaaggagtgggtaaagtagctggcaggatgattccaaggtagtaattcatacaaatagtattaagactaattaatgctctgtgttgaaaatacagtcacatgaagtcagtacaatttggtaaagcggtcttatatctttaggattaggagttgtttaggatagcctgaagattgtttaggggaggtaagtagacttgagtcacaagaataaaacctgaaattcaaaaccacagttgatttcatatttaagacacactgtatttgataattttgaatggtttttgacaaggtgtctttttatattaatagccatatacttaactagaccttttgatggtaagggagaccatgaacagactaactcactatatgagaggctgaatttgtggttcttcacatagtaaacagtagcaatatagaaggaaacatttatggatgtattttatgtgtgcatttcatgtaagtgataaagaaaaaagcagattgtgatattacccttctttcttttcttttctcttttcttttctttctctctctctccctctctctccttcctcccctccattcccttctcttcacttcctttttcctttcccttctccttccttccttttctcttttctttctttcctccctccctcctttcttcacttcctccttccctccctccctccctcccttcctgcctttctttcttcttttcttttctttctttcattttcttcttttttggcccacagtcaacagaagcatggagtgttggctcatatgctgttgatttgtagatttcactctactgaggatcctgaaactgtagataaaattgttcaacttgttttacatgaaaagctgcaagatgctgtaggaccccctaaagtagatcctcagtcagttaaaattaaaagtaagttaatttctcttatttttctttcatagaacagcttcatgttaggtttgatcttggcacttattaaaaaattttttttgatgtcctttaattctggggtcttgccaccaacagtatatttctttggaactaaatttgtcctaatgaagtattttaatttttaagactaccctaaacttaggcctcccatgcaagctttttattaactccttagcagttttctttatattacactttatagtttggctatagaatccaattataagtgaagaaaatggctttgtattttcttctttttcttgttgctttcattgtatgttctgagggtgtggtatatggaaaggttcatgccatttacacatttgttttcaaatgtcattaatataccttgctatactttcttcccttaaacttttcaccagtgaaacatttataataaacttatttttggtatatttacaactataaatgaaaaatttaggtagatttttgttgttcttgttgttattgtttgtagggccacatgggacaaaacaagtgatgataggtcctcacatttagaaaataagaaatatgagatcctcagtggaaattaagatctggctaagggctggttcatatgttacagaacaatgaaggtctatagaaatactatctgggcacaagtataatgttacattttctagaagttacattaaaaataaaaataaacatgtaaaattaattttcaataatttgtatattcaacccaatatgtccaaagtattatcatttaaacaaatagtcaatgtaaaaattattcatcaaatatttcacttttttttgtagtaaggctctggaatctagcgtacattttatactgatagtacatttcaatttagactagccacactgcaaaagctcattggccacaggtggctagtggatacagtagtggatatggcagcactggaaactacagagtaggggacaagtagagagaatgaatacaaactgctaatataatatctgatagatctaagtagatgcctaaattgatggccagccaacccacttgcttaggaaggaggcttcagtagtcagggacagatacataatttatgcgccttagcacaaaatgaaaatgctagacctgttttcaaaaagcaagaaaaaagtgctgttaaaagtacaaagatataacacttttctttcttccctggtctcgctctcgactttccatggtgttttcatttgctgattattgtcattctaagagaaaaaaattaaatttgtagattactaatatgagtttaattgtttatatcatgcaatgtcgatataaatgcatatataagtacatttaacttgtatttcaaatcatggaaattatgcaactatatttcgtagcttatacatacatgtttttcatttttgcctcaatggaaatagtacaaaaggctaatgactctttttattttcctggttaatatgagaaaattctaccaacactctctaccttcagcttattgaggggtgaggaaggactagaaggaaaaggagatctggatttccctatctttctctttctacattgtagttttcagcaaaagttgttggctaatacacagaagtaacagaagcaagaaaggatatggcaggatctgttgttcatttgtgtttattagaatgctattgtcttttctatgggttctaagcaagttttggttcaaacagaaaacatggcctccaaggcatgtcagtccacctctgcttacttaatggaagggatagcacacttaccttgtacttgctttgagtcttgctgaacccctgtggattgtgggtccactagaattctgatttcatagggaattgtgaatgatatatgcaaatggagtggaaagaaactatggacacacttattgcacatatcttgtctgccaacactataatccattatcctattgaacttcattttcaaaacacaagttacaagataaaattattaagaatgtcaagtgagcaatagcagagcattgtaccaagcacaaggccattgtgagtgtgagacccagtgcagatgtataagtcacacatgaagccagccttgtcagtgctatcaatactcagagcttgacattttcctaggaagagcttgagatagagaacaggttatttgaaacaaagagatcagaggtggtccttttaatattaactgagactaaattgtaaattcttccttatttttgccattttccccacaagtagccagaataaataaagtcagaaagaaggccttctagaatatagatttccacttcattcatactattaaatactaaagaaaaaaattaacactaatatttttgcatttagagcatccatccttccatgtacaaagaatagttttggtcattagaactctgctgagtcagaaagtttgagcttagagttttatgtatctattagctgggttagtgtttgcatagggtttgagactgactagtgagaagtcagcaagctaagaagtcattggctggagctaaatgacaatttgagggcagactgtcttttgaaatttgacttcaaaaagggtaacattgtttttaactgtgagtgagtacaaatttatggagatgctactcaggtgtgttatacaaatgggactaggcttatgagctcaatgatacaatctgaaataatggttaataaaggtattgttacatttggggaattaatactatggtttagagtagtatttcccatggaggggctgtggactctctgcatcttatttactggtataaaatccaaattcttgggcgtcattacaagctactgaattagagttactgggaaggtgaacaggagtttcattataaatatgcttcctatgtgactcttacccacattaaagtttaacacaccgttcacattctctgcaatgtgatgatcatcctatgtctatgacaagctatgttgccttctttataatctagagatactgttttataataaaattaagcagccttttagtatttgaaatactcggaggcatagtgtaactctgatgtgctgaccctatttgccatttctgtgtgtttcagaaatcaacaagacagaaacagacagctatctaaaccattgtaagtttaatatatttattgaaatagcattacctgaaggtaaaaagctaacactataggtcatttaggtttactttgtgttgatatcatagggacagaacacataaagtttgattaatttgtgtacagttcatggtactttatcatatcttggagatacattttattagtaaaggatagcaaaattgagataactttggagtggatgtatgggtgcctgtggcagatgtgtagtggaattgagttgtacagctgttaaagaagaggcaagaaatgtttacttatcaatgttctgtttgtaggtatctataagataaaacaaatctatacattgtgtttttcagctagaggcagaaactcattgtcactatatcctagataaaatcttcttgatgttattaatcctacggattaatacgaaagtgcaggaaattatcgggtcgtggaagagtcacagaaagtgcaggaaattatggggtatattttaataaaattactgaagacacatagataatatcttcacctatattataaaagtgctgagtctaggcctagcacttttcttctcctatagccaagtatgccaccatgatttacagtatacattcaatagttatggggttgttgcacattacatttctcttaaaaggtggaaaaatatgtgctactcaccagctcatatagttggttaatttctaaaatcaactaaacacaaaaccaaaagataatctcattacctaaatagcatatattctcaccaccaatatttattgggaacctaccatgtgctagcactgtgttagacaacaggcattccaaatggataagatataatatctctacctgaagcaccttatactttaatgggactaggtgcatgagactaattcatgaacacatcattcttaaacaacacttctcaaccaagggaaatattgttggccaagctatcatgccccactgtggcatttttgtcatgaatatagggggagggctactggcatctacagtggatctacagtatataggccaagatcttatgatgcacagggcagccccctacaacaaagaattaaatggttcaatatgttagtggtgctaaggttgaggaaccctgtcataaacaatgtcagtatgtatacatacacataagcacacatacagagtgtgtttgttatacacataagcacacacacagagtgtatttgttactattattattttggaagcaccaagaaagtaataactaatccagattggagacaggggagttagagaaagcatcctagagaggtaacaactgatttagattttacaaaatgaacaggagttagctaaataaaacattacagtttacagaaaggtaagagcatgagaaaacatttgatacttttggagcacaaagtagaagaaatatgggacatagtaacacaatttgatgtgcaaaacaactgctaattaatgcacccaccaatgcaccccccctctctcttttgcaggctgcggaacacgaagaagtaaaactctaggtcagagtctcaggatcgttggtgggacagaagtagaagagggtgaatggccctggcaggctagcctgcagtgggatgggagtcatcgctgtggagcaaccttaattaatgccacatggcttgtgagtgctgctcactgttttacaacgtaagtcttgaaccttgagaatgattgggagtgaacaaagtgcactgggttttggcaagaaaatacctcatgaattttgggagatatgagtttagcataaattaaaaataatgtgtatatcacaaaagactggatcatttgtaaacattagtaagaggttttaaagtctggaaatggaaatggagtcaaagtatatgtaaataaataatcttttgataaacacacaatagtttctcaaagaaagcaggaattttaaagtcatttttggatttgaatttgctgtcaaacaggagtgctctatctctgctgagtaccttaatcagagatggagtctggataggttgtaggtttgatcctaagggggaaatttcacatggtaagaaaaagaattaaatacgaagaattatgtaatgaagatatgaagaatttggaagtagcaagttgtataaatgaatagattgactaattatattgcaagaaatggaggacccttcaatctattgtcaaaatgtctatagtatataaaataataatactttgttaaattattgtgtggactttttggttttcagagaaatgtgtatatttctgggtggggtacatgagacacatagaatatattaatttctcttattctgtacagggtactttccataggtcccttggagtcattaatatacagaaaaatcaaaaagccttagcatttggagtggatgacttggcatatggagtggcatgtatattataggaaatggtggctttttcacctggtcagaaccctgagccttattatcaaattggaaagagttctatacatcaaaactataaaaagaaaaaaaaatctacacctgtagactaaattatttaatataaattattcgactggtagcatggtaaaaagaaatttattcttcatttttttctccccagatataagaaccctgccagatggactgcttcctttggagtaacaataaaaccttcgaaaatgaaacggggtctccggagaataattgtccatgaaaaatacaaacacccatcacatgactatgatatttctcttgcagagctttctagccctgttccctacacaaatgcagtacatagagtttgtctccctgatgcatcctatgagtttcaaccaggtgatgtgatgtttgtgacaggatttggagcactgaaaaatgatggtgagcgtcggaagaggaactcaagtaaaagttaaattggtattttatggcatttaagcaatgaaatgccattatgccaaaatatgttagttgtgtggtcatatgacctggaccaagtcaggccctaaaagtgaagtaaataacttggaaggcacaaaaattccttcctgcctaagttaatatcgagtaaattgctactactatatactacagtcatagtactgctaagatgtctgaaaaagcaaatatgtctcctagccatgaactttctttagagaattaaccagtttagagattagcaatcaataatatacccaattctgaagattggagaatcataaagccaccattctcccctactgaaatttccttgtaatgttaacaatggagtggacattatttagataacttgtggttctttcctaggcacccaactttttgctcaaagtagttaggaacaaattatcttcccaaatattattgttctaaacatatgtagtctaagattctgtatcactatctttttttttttttttttttttgagacagagtctccttgttgagacagagtctccaggctgaagtgcaatggtgcgatcttggctcactgcaacctctacctcacaggttcaagcgattctcctgcctcagcctccccagtgattgggactacaggtgcccgcctaatttttccatttttagtagagacagggtttcaccatgttggccaggctggtctcaaactcttgacctcaggtgatctgcccttctcggcctccgaaagtgctgggattacaggtgtaagccaccgcacccggtatcccccgcttttttttttttttttttttttttaagatggggcttctttctgtcccccaggctggagttcagtggcccgatcttggctcactgcaacctctgcctcccgggttcaagagatttacctgcatcagcctcctgaatagctgggattacaggtgcatgccaccacccccggctaatttttgtatttttagtagagacaggatttcaccatgttggccaagctggtcttgaactcctggcctcaagcgatcctccaatctcggcctctcaaagtgctgggattactggcgttagtcaccgtgcctggcctgtatcaccatcttattcctaatcatgaaacattttcttcaagtttataaaatatatgtatgtctacaaatacaaagacttttttttcttttaggttacagtcaaaatcatcttcgacaagcacaggtgactctcatagacgctacaacttgcaatgaacctcaagcttacaatgacgccataactcctagaatgttatgtgctggctccttagaaggaaaaacagatgcatgccaggtaaacagttttgcccattagtatgttgtgtaattttttgtttacttttctttgaaataattatatatctacaggaagttgcaaagatagtacagaggagtcacaacatctcacccagttttctccaatgattacatctcacataactatagttcaatataagatctgggaaattgacagtcgtacaaagtatgtgtctaattctatggcattttgtcacatctgtagatttgtgtaaccaccactacagttaagatgaagaactattctatcaccacaaagacctacctttttccctcctcctactatccctaacatctggcaatcactaatttattctccatctctataatttttcaattttcagaatgttatataaatagagtaacagtagctttttaaacagaatttaattttggatcatctattggtatttttggcttttttttgtagaaaaattttagtggttcctttaagttatatatatgtgtatataaatatatatttatttatatatacatacataacatcactgtctatgtgtattgaaattttactagttttggtggagtatagaataaaaaacttacttccccttaaatccctttgcttttccctctttaatattaaacattaacaaatataaacattaaatattaataaatataaatattaaatatttgctttatattttgagaaccacagaagacaatgttttgcttcaacagtcaaatgtaatttagaaaacataagaggaaaaggaaagactatttacctatggatttcttctttcctctttcctgattccttttttaaaaacagtcatttctgttttaggaacttcttttagccactcttttagtataggtatgctggtgaaaaattctcctagattttctttgtctctaacagtctttatttcttcttcattactggagcataatttagcactgacagttcttttctttcagcatttaaatcattgcctctgtgatttctgcaaggaatttgctgctattagaattatttttttccaatagatgaggtgtcatttcttgctgtgttcaagagtttgtctttagttttcagaagtttgattatgtatcttggcatggatttctttgggcttatcctgtttgaggtttgctcagctttttgaatatgtagatttatatcctttgtcaagtttgagaaattttcggtcattatttcttaaaatactctttcagtcccaccttctttcttctttccttctggaactctaaccacagcaatgtttactcttttattatagtcccagagtttcctaagcttttgtttattttttttgcactctagtttctctctgtttttgagattgggtaatttcaatgtatcttcaagtttactgattctttgctctgtcttctctattcttatgttaagcccatccagtgagttttgaattttgcttatcatattttttagttccagggtttttctttgtttcttctttttatatttactatttctttgttgacacttcctatttcttttcctttgttttaaacatgatggtaattgctcattgagatgtatttatgatggctgctttaaaatctttgtcaaataatttcaacatttgtgttatctcagtgttggtatctgttgattgccttttctcattcaagtaaaaacttttatatttcattgtatgatgactgatattcagatatatgctgagcatctaattattatttattctgttttgttgttgttgttatatcatgcttttaaatttatattattttatttaattaattactttgcttcttccaacttttattttaggttcagaggttacatctgcaggattgttacatgggtaaattgtgtgttgctggggtttggtgtacaaattatttcatcatgcaggtagtaagcataataaccaataggtagtttttggttctcatcctcctcccaccctcaaccctcaagtaagccccagtatgtattgttcctctctttgtgtccatatgtactcaatgtttagcttccactcataagtgagaacatgaggtatttggttttctgttcctgcattcatttgcttagtataatggcctgtggctgcatccatattgctgcaaaaaccatggtttcattttgctttctggctccatagcattccatggggtatatttaccacattttctgtatccagtccactgttgatggacattttaggttgattccatgactattgtgacaattgctgccatgaacatatgcatacatgtgtctttatggcagaacaatttgtattcctttgtgtataatatacccagtaatgggattgctgggtcaaattgtagttctgtcttaatttctttgagaaatctccaagctgcttcccacagtggctgacctaatttacattcccacgagcagtgtataagcattcccttttctccacaacctcaacaacatctgttgtttttttgactttttagtaatagccattctgactggtttgagatggtatcttattgtggtttttaatttcccatttccctgattagtgatgttgagcatttgtccatatgtttgttggctgcttgtgtgtcttcatttgagaagtgtctgttcctgtctgtattaggctgttcttacactgctataaaaaaatacctgggtcgggcatggtggctcatgcaggtaatctcagcactttgggaggccaagggaggtggatcactagagctcagaagttcaagaccagcttgggcaacatggggaaatcctgtctctgctagaaatacaaacattagccaatgtggtggtgtgtgcctgtagtcccagctacttggaaattatgaggcaggaggattgcttgaacccaagaggtcgaggctgcactgcacccactgcactccagcttgggtgacagagcaaaaccctgtctccaaaaacaaacaaacaaactaacaaaaccaagtaaacaaaaagccaatattaggtaatgtataaagagaaaaggtttaattggcttatgattctgcaggctttatgggcagcatggtgctggcatctgctcggtttctagggaggaagcttacaatcatggcagaaggtgaagtgtgaaatgggagggagcaggtacatcacatggtgaaagcaggagcaagagggatagagtggtaggagaggtgccatacacttttaaacaatccgatctcacaagagctcactcactattgcaaagataactccaagccgtgagtgattggctcccatgacctgaacacctcgcaccaggtcctaccttcagcattgggggtgacaaagcaacatgagatttgggcagggataaatatccaaattatatcattctgctcctggcctctcccaaatctcatgtcttctcacattgcaaaatataattatgccttcctaacagtccccgaaagtcttaactcattccgactttaactcaaaaattcaaagttggccagatgcagtggctcacacctataatcccagcattttggaaggccaaggtgggtggatttcttgagcccaggagtttgagaccagcctgggtaatgtggcaaaactgcatctccacaaaaaaaaattagctgggctttgtggcatatgcctatagttccagctgtttgggaggctgaggtgggaagattgattgatcgtgggaggtttaggctgcattgagctgtgatcgcaccactgcagtccagcttgggtgacacagaaagacttcattttggggaaaaaaaaaaagtctgaagtccaaagtctcatctgagataaagcaattcccttccacctcatcaatctggatttcactgtcgatgtaactatcagcattttggtcacaaccatttaaccagtttctaagaaatttcagacttgatcatatctgtcttctgagccttcaaagttcttccatcctttacctgttacccagttgccaagtcgctttcacattttccaatatctttatagcaatgccacactcatagttaccaattttctgtgttaggctgttcttgcattgctattaagaaatatctgaggccgggtaatttattagaaaagatgtttaattggctcatggcttttcagactttatagtaagcctgatgctggcattaacttggctcctagggaggcatcaggaagcttataatcatggtgggaggtgaaaggggagcaggaacatcatgtggtgaaagcaggagcgagagagagagagtgggaggaggtgccacacacttttaaacaaccagatatcgtgacagttcactcgctatcgcaaagacagcactatgctgtcagggatccgttacccaaacaactcccaccagcctcacctccagcaatggagattaaacttcaacatgagatttgagaggggacaaatattcaaactgtatctatgttttttttccccattttaaaagggagttgtttgttttttgcttgttgatttgtttaagatttcttaaagattctggatattagacctttgtcagatgcatagtttgcaaatattttttcctattctgtaggtcgtctgtttactctgttaatagtttattttgctgtgcagaagctctttagtttaattagatcccagttgtcaatttttgttttagttgcaattgcttttagagtctttgttataaaagctttgttaaggctgatgtccagaatggtagttcctaggttttcttctagagtttttatagttttaggttttacacttaagtatttcaaccatctcaagttgatttttgtatatggtgaaagaaaggggttcagttttaattttttgcatatggctagccagttatccccagcaccatttattgattagggagtcctttccccatttcttgttatggtcagctttgtcaaagatgagatggttgtagacatgcagctttacttctggcttctctatttggttccattgatctatgtgtctattttttttgtactagcaccgtgatcttctggttactatagctttgtggtatagtttgaagtctggtagtgtgatgccaccagctttgtttttttgtttaggattgctttggctattaaggctcttttttggttccatataaatattacaacagtttttactaattctgtgaaaaatgacattggtagttttataggaataacatttaatctgtaaatttctttgagcagtatggccattttaacaatactgattctttctattcatgaacacaaactgttttaccatttgtttgtgtcaactatggtttctttcttttttttcttgagacaaggtcttaccctgttgatcaggctggagtgcagtgccacaactatagttcactgcagccttgaactcctgggctcaagcgatcctcccacttcagtctcctgagtagcggggactataggcattcaccaccacacatggctaattttttaggtttttggtagagatggagtcttgccatgttgctcatgctggtcttgaactcctgagctcaagcaatcctcctgcctctgcctcctaaactgctgggattacgggcatcagccactgtacctggccttcaactatgatttctttcagcagtgtttttaattctcattgtagaggtccttcaccttcctagttagccatatgtctatgtattttattcttcttgtggcaattgtgaatgagattgcactcttgatttggctctcggctaagatgttattgttgtatagaagtgctcctcattttagtacattgattttgtattcagaaactttactgaagttgtttatcagttctaggagcctttgggcagagactgtggagttttctgggtgtagaatcatatcatttgtgaagagagatagtttgacttcctctcttctatttggatgccttttatgtctttctcttgcctaattgctttggtcaaaacttccagtactatgttgaataacagtggtgagactgcacatccttgtcttttctggttcacaggggaatgcttctagcttttgcccattcattatgatgttggttatggggttgtcatagaaggcttttattattttgaagtatgttcctctgatgcctagttagttcaaggtttttttcttttttttctttttgagacagagtctcgctttgtcacccaggctggagtgcagtggtgcgatctcagctcactgcaacctctgtcccccaggttctagtgattctcctgccttagcctcctgagtagctgggattacaggtgccaaccaccatgcctggctaatttttgtatttttagtagagatggggtttcgccatgttggtcaggctggtcttgaacacttgacctcaggtgatccacacatctcggcctcccaaagtgctgggattacaggcaggagccaccgtgcccagacatatttatttattttcatatgttgaaccagccttgcatcctagaaaataagactacattactgtggtggataagctttttgatgtgctgctggatttggtttgcaagtattttgttgaggatttttgcatcaatgttcatcaaggatattgtcctgaagttttctctttttgttgtgtctcttccaggttttggtatcagaaaaacactgccttcataaaatgtgttagggaggcttctctttttctagaattttgggagtattttcaatataattggtaccagctcttctttatatatctggtagaatttggctgtgaatctctctgttccagggccttccctgttggctgtttttttaaaattactggttcaattttggaactcattatttatcttctcaggtattcaatttcttcctggttcaatattgggagtttgtgtttccaagaatttatccattccttctagattttctagtttgtgtgcatagaggtgtttacaatcatctttgaaattttttgtaaaaaatatttctcttccctttggcatttctgatggtgcttatttgaaagttctttcttttttttctttgttagtcttgctagcagtgtatcaatcttatctattctttcaaagaacaagttgtttggtttcattgatcttttatatggatttttgtgtctctatttcattcagttcagctctaattttggttatttttgtcttgtgctagtttaggggttcacttactcttgtttttctagttcctcgaggtgtgatgctacattgttaatttaagatatttatatcttttcgatgttggcattttgccccataaactttcctgttaatactgctttacctgtgtcccagaaattccggcatgttgtatctttattttcattaatttcgaagaatttcttgctttctgtcttaatttcattctttactcaaaagacattcaggagcaggctgtttaatttccatgtaattgtataattttgagagatcttggtattgatttctatttttattgcactgtggtctgagagtgtgattggtatgatttttaaaaatttgtttagaattgctttatggccaagtgcatggttgatcttagagtatgtgccatacatatgcagatgaaaagaacgtatattttcttgttgttaggtggagtgttctatagatatctcttaggttcatttggtcaagtgttgagtttaggttcggaatatctttgttagttttctgcctttataacacctttagaggggtgttgaaatctccactataattttgtatttatctaagtcttttttgtaggctctaagaacttattttctgagtctggatgctccagtgttggatgcatatacatttagatagttaatcttcttgttgaattgaacactttatcactttgttacaccattttttgtcctttttaattattgttttaaagtctgttttgtctgaaataagagtagcaacccctgttcttttttgttttttatttgcttggtagatctttccttatgcctttactttgagactatgagtgtcattgcatttgagatgggtctcctgatgatagcatacagttgggtcttgcttctttatccaatgggctactctgtcccttgtaagtggggcattaagcctgtttatattcaagttataatattgatatgtgaagatttgatcctgccatcatgttgctagctggttattccacaggcttgattgtatagttgcatatagtgtcagtggactatgtaattgtcttttctgtggtgtcaggaatttttttttttttttgagaccgcgttttgctcttgttgctcaggctggagtgcaaaggcgcgatctgagctcactacatactctacctcctgggttcaagcgattcttctgccttagcctcctgagtacctgggattacaaatgcatgccattacacctggctaattttgtatttttagtagagatgggatttcgctatgttggccaggctggtcttgaactcctggcctcaggtgatctgcccacctcggccttccaaagtgctgggattacaggcgtgagaaaccatgcctagccaggtaatggtcttttgttgccatgtttagcactctcttaaggactttttgcaaggcaagtctggtggtaataaattcccttaacatttgcttgtctgaaaaagattccgtttctccttcgcttatgaagcttagtttggctggatatgaaattcttgattggaatttttttctttaagaatgctgaatataccagcctggccaacatggtgaaaccccatctctactaaaaatacaaaaattagccaggcatgctaatgggcgcctgtaatcccagctattcgggaggctgaggcaggagaattgctttcacctgagaggcagaggttacagtgagctgagatcatatcattgcgctccagcctgggtgacaagggtgagactctgtctcaaaaaaaaaaaaaaaaaaaaaaaaagaatgctggctgagtataggtccccaatctcttttggcttataaggtttctgctgaaggttctgctgttatcctgatatcaccccctttgtatgtgacctgtcccttcgctctactgcttttaagattttttctttcatgttgaccttggagaatctgacgacaaggcgtctagaggatgggtgtcttgtatattatatctctggggttctctgaatttcttgaatttgtatgttgacctctgcagcaagattggggaaattttcaggaacgatattcataaatgagttttccaagttgcttgctctctctctttccttggggatgccagtgaattgtagatttggtatatttatataattccatatttcttggagattttgttcattaaagaatatctttttctttatctgactgagttgatttgaagaactggccttcaagttctaaaattgttttcagtttgatctgttctgctgttaatactgcccattgtattatgaaattcttgtagtgagtttttcagctctaggagatcagtttctcttcttttctttccttttttcttttctctcttctcttctcttcttttctctcagagtctcactcggttgcccaggctggagtgcagtggcaagatatcggctcactgcaagctccgcctcccgggttaatgccattctcctgcctcagcctcctgagtagctgggattacaggggcccgccaccatgccccccggctaatttttttgtatttttaatagagacggggtttcaccgtgttagccaggatggtttcgatctcctgacctcgtgatctacccaccttcggcctcccaaagtgctgggattacaggcgtgagccaccgcgcccgaccctgattctttcttaaaatggcaatttcatctttcagctcttgtgttattttattgatgccataagttccttagactgtgtttcaactttcccctgaatcttgatgatcttcattgacatctgtattctgaattccatgtctgtcatttcagtctggttatgaaccattgctggggagctagttcagtcatttggaggtaagaagacactcttgcttttagagttaccagagttcttgcattggttctttctcatctgtgtgtgtgaagttgttgtcctttgtatggagctttttacttttatattctttgatgccttttgtggtttgattgtggtattagttgtgcttagttaatttcattcgtttttggatgatttcaggggtccaagggttagctcagcactcctgggctgcatgctgtaccaggctgtaaccttgggaaattgggaccaggtctgaggcggttttctctagcccctagaggttaagtacctcctgggttggaaggaatgaggtgttcctggtccactggcaacaaaactgtgctggcaaaggcactttggcggggtggcagtgggtcagtgagggtccttgtgctcacatacgtgctggtggtggggtagtggcaagtcctgcacaggcatgcgtgctggtggtggggcagtgatggggtcagtgtgcatgcatacaccagtgagtcagtggctggaggctgcaggcaaaggcatgacagcaaagcagcaggtagaggctgccagtgagtgcatgctggtgggcgctcactgacagggacctgccttcaggagctctccagctgttaggcagggtctgccatcaaaatagcaatggctgtggctgtcaaaaaatgccttggctgggcagctgaggcagtgctgcaagtttgtgtagccaggcagggaatttggcataggccagcagacaagcgagtgcttggatcagattgttcccatcccacaagcaagagagccctgtgatgtccaggtctgtccatcaacaaaggcgaaagccacctagagatgtatgatatttgggggatgggcacccatgccatgctctgctgtagccattctcatgccaaaccctgtggactctgtgcaggctagaattctgtctctttcaactctccaggctgttctccctgccaccttaactgtccatgggggatgaggggtctcctgcagctaagattctggaggtctgtggtgtgagttggccactccatgaccatttaacttactccttccccaggagcctctccaggccaggaacaagttctggtgcttggcaaccctgtgcagggttaccagcttccttccctttcagcctggggtctgcattctccttccatcaactctcaatgccttctttctgaaaatttgttcagagtgtgccagtcttcttgatggtctggtccctcactgggagaaggtcttcttgtctgcgtctggtcggccattttgttttagtatttattaaataatgaaataataataatttgaaaaaattaaattattattatttaaaactctagatcttatttaaattttctatttaaccatgcctcagcagacattgtgatgcagagggagggggatgtatgaaggaattgcctcatttcccactcagcttcctttgatgctcaggtgagggactaatgctcattactactgcatggaggttaggcctcttctgataacactctggctgaaggtactttgttactgctccccttttggcctccactgacatcatggggtagtgatttcattactgcttcgcagtggtgaaagacttgacttcccactacctctcctcagacatggttctagtagatggggagagttattcctcattactgggtggtagttcatgcttcccactcagcatattcttttttttttttttttttttttttttttgaggtggagtctcgcttgttgcccaggctggagtgcagtggtgccatcttggctcactgcaacctctgcctcctaggttccagcaattctcctgcctcagcctcctgagtagctgagattaaaggcatgtgccacgacacctgactaatttttgtatttttagtagagacggcgttttgccatgtttgctaggctggtctgaaactcctgatttcaggtcatccacctgcttcagccttccaacgtgctgggattacgagtgtgagccactgcacctggtgcctattcagcatattctgacaccaatctagtagggaattgggccttcttacagcctggtaagcatggaagtcttttcagttgggatttattgtcttcctggatttgctgttttcccaagttgtcctcttattgattattttactagggagagcaggattttcttggagccttttaaaaaacttgcacttgttggcaggttgccaggttgctggcttcttccaagtccatgatatatgaagcaaaaaaaaaaaaaaaaaaaaaaaaaaaattgagagagctcactcttgtatcattccttttgtcctgcatttctgagcccacctgtcgtcttctctctaattttcagagtctttttatgtttgttttatttgtaatgcccaggtatttttttgtttgttttagccatatttagctggggaaaaaagaataagtaagtctgtcccatattggtctggagcgtttacatatttttgaagccgggttttgttttccagtgtttggctattgccaccaattttgtgcctttggtggatacaaaaattttgacctctatgtcttcatgtgcatcactcacaaaatcatggagggggccaataactggttccttctgtgtgtcactaaatgctttcataattttcattttgtgatttgacagaatttttgtttaatgtgctttctaagccctatagttctcttcagaattccatgttactctgtgtgctttctaatctgtattcataaaatggtaccattaatttctaagatttttttttacaatttttaatgttattcctttcatgctttcgcatgaacactatctgtattgccttcatttgctccacctcatttaattccctgttggcatcactatagttctttcccaacttttacctttgggttagtcgttttagcaatgttcagtttgctacattaaattcttttattcagttgacctttgtttatactctggcaaatgcccaagtttagactcacttcattttgtttctttttctgtgtttcctaattgctcctggaggaacacacggaacaaagtagattggtcccattaccacacactactaaaaattccttcctaacaattgaaattgattctgtaattcaatctcctgaaatgaattcaacttaaaagatgacttgaaaatatacttgatccttgttatttgcagattccatatttgcaaattcacctactcactaaaatttatttgtaacccccaaatcaatactcaaggcacttttatgatcattcacaagcatgcacagagtggcaaaatatcttattactcaatgagcatattcttacctgaggttgaaaaatgtgatactgtgcctttttgtttcagttctcattctgtaaacaagtgtcttttcttggtctacatagtgctacatttttcacatttttattatctttgctggcgattttgctgtttaaaatagtccccaactgtagtgccaaagtatagtgcaagaaggttgtgatgtgccatatggagaaaatatgtatatttggtaagctttgtttagttataagttttagcggtgtttactgtgagtttaatgttaatgaatcaacaatgtatattaaatagaacgtctttaaacagaaacacacacgaaatctgtttatgtcttgagcagttgacaaaaatgtgaccagagtctcctggaaaaccaaccctgtatttctcctaagaacaaggactcaacagtcattaattcagcatttgtggtgacttcacagaacacgactaccatgaataatgagaataacctgtattttatttgtcttcttgacggtcatggaatcattgatggtttagatattatgctagaccttcttttgtcctaatcatcatcatcctacttgcctccaactttcctgaaactgttgaaaacatcgtgcacttttacatttatgatcatccattattttctttattcaactatctcggtttctatagtctctatagtaatgtccttcctaaaaatttcagagaaacagatgtatgccctcttaatcttttattttataatttttattataaaaatttcaatggtatgcaaaaatagggaggataaaataatgaactttcatgtactcatcacctagttcaaaaatttacaactcatggccaaccttacgttatccgtacataccctgataaaatcccctcatcccctttccctaccaaaatatcaaatctattttgaagttaatcccagatgttatatactttcatctgaaaatgtccccattcaaaaatactattttgatggtgatattagaggtacacgctttacaaactttgtgagctacagaagagaagccaaatttgccctatgattacaatattctactttcttatctctgggaagacatggcacccatttttttgggggggagggatggagtttcatgcttgttacccaggctggagtgcagtggtgtgatctcggctcactgcaacctccaccttctggatttaagctattctctcgcctcagcctcctgagtagctgagattacaggcaaccgccaccacaccagactaatttttgtatttttagtagagacaaggtttcaccatgttggtgaaaaattccttcctagcttccaggctggtctcaagctcctgacctcaggagatctacctgcctcagcttcccaaggtgctgggattacaggtgtaagccatcttgcccagcctccatttaaaaaatgttcatgtctagcatccacagtttttaccacttgccttgctctttatattttaatatcacaaaaaccactaataacctcatatgtaaaaatttttccttgaatctcctactgtttctcatctcagtggtatttggcgaccttgcctttcttaagacatatcccttgtttgaatttcataattctgaaatttgctgatttctttcctcctcctccatctactcatttctggctgtatcctttgattaatctttctctctctctctcaatctggctatgctcaagattcagatctcagataaagtttttatctgctgtctatattctcactcaaagaagccatcttttctttgaactcagctatcaccttaatgagtgccaaacctgtgtctccagaattcaactcttgcccatatttagtcttacatttctacctacttcaaagtgatttctatttatatattttaagttcttaataggaaatgaaaatttgtatatgtgccatttgaaactcaacaggcatcatgaaatgttgcctgggtttttaagtttctcgctcatattattagggttcactattagagttttttttactcttatgtttcctccacatgtattcagttaagtcctagactattttcccactttaccatatcttttatgtttatttcttatgcccctattatttctgttaacaccctaatctattccctcatttctttgtgtcttaatacttccacggcttcctgtttggcttcttccaattttagaagtttctgaatacacttcctgttctgtttctcactaaaccattcactaaaaataacaggattaatgagacaaatagagatagagacagactggtccctcaaaagctatgcaactttataactgaagaattaacaaatataataattggtacctttaaaaatagcttgcacagtgtaggcaggcaaaacgcccaaggtctggtggcttactcagggcatgttaaaaatgcaaagaaaaataatgtggaaacacaggtttgctggtgctaaggcaatatacacagggaagtgtagtcctgagcagaagaggaaatgcaacctaaaactgatacaaagctaggatacatctctctggggagggagttttgggtacaggcactcaggcattttcttaaaacagtgccccaaatgtgtctgcctgtgtaatagctgagttgaaagggttttccttttcttctgaagtttataattccactcccattattctggctcccttgcctaaaaaaaagcatatctaaaccatcataatttccatcttctactgacataactctgccattcactaatcaaatgtgagctaattagtgctggtagaatagactctatatttttttctatttgatacttgctggacatcaccttacttttcagcttgtaatgctatttactgctatttatatactattatttatattatttactatttgtatactgctatctctttaaaataattatttattctcggactcatttattcctgtctcttatgctgattaaagctttgttttctcttgtatcttctatttctctatcctgattttctctgcctgcatatagacttgggattttattatcaaaattatttatttttgaatagcttcatatggcatatcttatttctataagcagattgcaggtttctagaggacaagatccatgtgtttataatactctttttatatctcctcctacatacgagggtatcagtaaatgcttattggttagttgatttaaaatcacaaatgtattatttcaaatgtactattatattagttaattttttaaatggacaaaagaaaattcacaaggaagttagcataacgtagggaaaaaagcatgggcttctgaattagatcgctctggattcaaattcggggtctgccactgattagcacgtgatctcaggcaaattacttaatgtttctgagtttcagttttcttagtaacccagaaaaaattaacctagttctatgttttttgtaaacaagaattacatgaattaatgagataatattttaatcaattaagaacttcatagagtgagtatgaatacttaatgggtggtcaataattagaagcgccaggatcttgaggaataatcagccagtacctcattattacaagccatataaagaatcaaaactctggagtttgcaggatataaataatgagaatttgtgattttatatatgcatttcctaagttctgccttttgctagactaagcactttacattcactgtcttacatcatcttcatagcactcatcacaggtaggtattattaggagcatttacagataaataaattaaaggtcttagccagcatggaaaggccaaacttgagatagaaaccctggtgtctgactctaatgtctgtttttttttgtttgtttgtttttttaaaatcagtaatagactcttcactcccttttttggggggttatgttacactaataaagagtatagacaaaataattagggagttattttgtcagatgtgtcacataagttaagagtacagttcttcaaagagatggaggcttcaatctcattgttttgaaggtttcaaggtatttcaaggtttcaaggtttcaatctcatcagttttcaaggtattggaggtcctcttttaggtggataactgacatagatggagaaaatcacttatgcatgcgaacacacggaatacttttgaaaattacccctttcattacattcttaagttagaaaaatagccaattcctctgtaatgaactgaattatgaattactaatttctgtcttctcctttagggtgactctggaggaccactggttagttcagatgctagagatatctggtaccttgctggaatagtgagctggggagatgaatgtgcgaaacccaacaagcctggtgtttatactagagttacggccttgcgggactggattacttcaaaaactggtatctaagagagaaaagcctcatggaacagataacatttttttttgttttttgggtgtggaggccatttttagagatacagaattggagaagacttgcaaaacagctagatttgactgatctcaataaactgtttgcttgatgcatgtattttcttcccagctctgttccgcacataagcatcctgcttctgccagatcaactctgtcatctgtgagcaatagttgaaactttatgtacatagagaaatagataatacaatattacattacagcctgtattcatttgttctctagaagttttgtcagaattttgacttgttgacataaatttgtaatgcatatatacaatttgaagcactccttttcttcagttcctcagctcctctcatttcagcaaatatccattttcaaggtgcagaacaaggagtgaaagaaaatataagaagaaaaaaatcccctacattttattggcacagaaaagtattaggtgtttttcttagtggaatattagaaatgatcatattcattatgaaaggtcaagcaaagacagcagaataccaatcacttcatcatttaggaagtatgggaactaagttaaggaaatccagaaagaagccaagatatatccttattttcatttccaaacaactactatgataaatgtgaagaagattctgtttttttgtgacctataataattatacaaacttcatgcaatgtacttgttctaagcaaattaaagcaaatatttatttaacattgttactgaggatgtcaacatataacaataaaatataaatcacccatttgcttgacattatgatatgataatccacaaagaaggggaagatgggaaaaatgttactagtcaatttattgtaaatttttttaaaatttgaggctaggatgaaaattaatttaataacaatcagcatgcttatgtactaaaataattgcgttgtggaatgggagggaacgaagagttcaaacaattgactggaaaggttttattcgtctaagactttcccaaacagcaaatccttgaagggaatgagatccaggtgttagtgtacagtctagtgatgcaactgaactggggctcagacctctattttgagatgattgtagatatttttcttcccctgctgctgtgtttacagttcatacatggttaatggtcctgttagactcctcttcgctgagatggaaagataccatagagaaaatatcctggaagctgcctcactgctgcatctagtgtgacactgaatggctaactgcctggataacaaaactgaagagtaaaagcatgatattggccaccttcatgatttttagttttggtaaattattactgagctgttagagacacagctttcaagtaatccagaccgtaatgaagttaggactggtaccatgatgtacggcatgttaatggtgagatttcaccaagtctgtcctcattgcatatagctactcatataagttctatattgtacaataattaccctgaaaaccagtattgccacgaaaaatttaagtttattgatctgaataacactggagtatgaactgataacatttaggcacttggcaaaaatatgaaaactgacatgaattgatagtgctaaatattttgcataagctatttttgtttcatttagcaaaatgctctgggaaaaaacaaaattgaggaaaaccttgaattttaagcaaggatataagtacctttaaaactactctcagtgttctgttaaaaatggattcctcttgtttcagtgtattctgtagttgggcctctaggtggcacccacaagctgtaggaagctatggggaagcctgacatcaagaaggatgtctagatctgtaagtaataatgagaactgtacctgaaattagagtctcgtgaaaccaaaagaatacagtttttctttgcaaatggcgtttaaaaattaattcgtgttgatttacatcattattcgtatttttcaaatttctggacatttgattccaaactaaaataaaatttatgttgcatgatttgaggaactccctctgcaaaagcacctggagcaatttaaattaagaagaaattttaaaagcttaattttgcaatgacatcttattcctaagagaaatacttttgatatttccttctacaaaggatttgagaaatagaagtttgggtcaaagtgaaaatatgagcgatagttcaaactttatgtacatagagaaataggtaatacatttctaaaatggtaacttcttttgaaaagtaattaccaaagggttttatctgcatgtctgtgttaactgtttcattggagatagttaagaagatgtgacgataatatttattacttttttcaagagggcaggcagttcctcttctatatcttcgatctctcttcctacagcactagtaaagtactctgtatataacagtccttcaataaatgttgttgaatgactcttttatttttacattatgcagaaaacatagctttattattatttacacattgatttttaaaattaatcccagattttacactgagtgaattaagccggttactatttatctaagcctataatctcacccgtaagatagagatgatatttgctcaaatgattgttgtggaaataaaactgtgaatgtttaaaaagtgcttagcacagttcttggaacattagtaggtgttcaagagaccatagtaataataactgttgctataatgaaactacactcttgttttaaaaaatatggtatttgattataacaggctgaataccttttttttttgaaatgacaagataattagaccaacaaaatgtgctagttaaaaaaatttctgattctacaaaaagttttactgggataattccgaaacatatttatcaaagtggtctgtcaatgtgagggttcattctaacttttgacttcaattttaaaaaatgataaactttattaaccaccgagtggctggattatatcaagatctatggtgtagttcaaatgtcgcctcttccctgaagcctttttttacttcctcaagtggatgtactatacgtttcttctgaacttccttaccattaattttttttattttcagataatcattgattcagatacggttaagatataactgtaagatataattcacagagattctgtgtaccctttactcagtttacctcaatagtaagatcttgcttaggtgtagtataatattacaatgaagaagttgacattgagacaatccattaactttattaggatgcaatcaattatatatgtgtgtgtaggtgtgtgtgtaattagttctatgtaatttaattacatatgtagattcatgtgattaccaagatacagatagtttgttcacaaggctacatcacgctaccgacagccatccagctccctccctaggcctgtgtctagtctctaatccctggcaaccactaatctgctctccatctttataatttttattgtttcaagaatggtatataaatatattatacaataagtaactttttcaggttggctttttcgctcagtataattttcttgagatctgtccaagttgttgtgtgtgtcagtagttaattctttttttattactgagtagtattacatgatagggctgtacctcagtttgttaactgtatacccactgaagggcatttggattgttctcaggttttggctattacaaataaagctgctatgaagatttgtgtgtaagcttttgtgtggacataagttttatttttctgagatttatggcctagagtatgctgggtcatacggtaagtacatgtttagatttttaagaaacggccatattcttttcacatggctccttactacttgtaaaactctctgtacttagaatatctacctgtgtatttcagatgtgcagatagatgtgatttcaacaactagactgtaaactccatgagggtggggacagtaactggttcatttttatatccttcacagttcacaggaaactataatattgtttatggcagttgttctataaagatttattaaataaaaataaagagtaataaaagcaaacaaataaatatacatgaaataaaaaagaagaaatggctttgggtagaaaagaatgaacagtatttccttcatgaaggtattactgctcaatttctgtaattctgcatggactctaccatggcacttccatgtatcttatgttggttgatataaagtctgtttttcacctttccacagggtacacaatcaaacatagactaaagacatggttgatatggagaatctctctttatatctgaatttagtttctgatacatgttatatttaagagttttctgacacatctgtatcagcttctactgtatttgtggaatggattccagtttaggagcacaatcaataaatatttgttgctcttactttttataactatgattctataatttgtcctaatgtaatttttattatataactcaaggtggagtgaaagacagagacctgtgaaatgtaatcagaagttctctcttaattgtccctaacacaataatcagtacctctttggcgtagatgtagtcagcttaaattttacaatcacagtactcactgccttgcatatacccctcacctgcttgttctcttgctccaccactctgtgacacttgctttttactatgatcctggtaaaatttaactctccacttactgtttttaaaaactaattaatttcccccaattttattaaagtataattggctaataaaaattgtatatagttacagtgtaaaatttgatgttttgatatatgtatacattgtgaaattatttaatcaagctaattaatatattcattacctcaatacttactattttttaaaagaacatttaatatctattcagcaatatctacttttaacaatttaaaaatactcaatacattattattaactgtagtctccatgctgtaaataggcctccagaacttatttcttctatataactgaaactttgtaccttttaatcaatatcttctcatttctaccacactccagcctctagcaaccaccattttactctctgcttctattagttcagctttcttagattccacatataagtgagatcatgtagtaatcagcactctgtgtttggcttatttcacttaacataatatcctccagattcatctatgttgtcacaaatgacacgattcccttcgtttttaaagctgtatcatattccaatgtgtgtatttctttattcttccaccaatggacatgtaggttgattctatattttggctattgtgaataatgctacaataaacatgagaatgcaagtatttctgtaccaaaagtgaaaaacagaatggttgtatggtacttaaagtatggtttctactgaatatttcaattaatcactgctgagataaccaaaatagtgtgtaaaaaacaagcaaatcagcaaaaccaaaattgcactttttcaaaatgtcagataaatgactaatcttttaactagactgaactcccataaaggagatgattcacattttaataataaagtcagatataatagtaaagacattattaccaatcatacagaaataaaagaattataattgtatattaggagcactggtatgtcaacaaattataataacttagatgaaatgaacaaatctctaaaagacacagtcatacagactcaagagttctaacacaattccattatgttcaaaggacacacttcgtatgatttcagtacttttattgagagacacggcctagcaatggcctatcttggaaaatgttaatgtacttgagaatattatatacagtcatgcattgcttaacaacagggatatatgaactgcattgttacatgattttgttgtgtgaacatcatacagtgtacttacataaatctacagggtgtagcctactacacacctaggctgtatggcataatctattgctcctaacttacaacctgtacagcatattactatactgaatactacagggaattgtaacacagtgggaagcatttgtgtatttaaacataactatacgtagaaaagttactgtacaaatacaatcatctaaaaaattaaaaaatggtatacctgttaaaattcttatcatgaatggagttttcagggctagaagttgctctgggtgagtcagtgagtgagtggtgaatgaatgtgaaggcataggacattattatacactaccgtagactttataaacaccatgcacttaggctacactaaatttgtaaacaattttccctcttcaatgaaaaattaactttagcttactgtaacccttttaatttataaactttaaatttcttttactttttgactcttttataatagcacttagcttaaaaacaaacatatttttcagccatacaaaaatattttttctttatacccttattctataagctttttaaaatattttaataatttattattttttacctttaaactttttggttaaaaactaagagcccaccacagctcagcaaggccactgtggccagactgactctctagattccctcctctctgggcagaacatctctgaaaaaaaggcagcagccccagtcagggacttatagataaaacccccacctcctgggacagagcagctgggggaaggggtggttgtgggcacagcttcagcagacttaaatgttcctacctggcagctctgaagacagcagtggatctcccagcacagcgttcaagctctgataagggacagcctgcctcctcaagtgggtcactgacccccgtgtatcctgactgggagacacctcccagtagaggccgacagacacctcatacaggagagctctggctgacatctggtgggtgctcctctgggacaaagcttccagaggaaggaacaagcagcaatttttgctgttctgtagcctccgctagtgatagccaggcaaacaggttctggagtggacctccagcaaactccagcagacctgcagcagagggccctgaatgttagagggaaaactaacaaacagaaaggaatagtatcgacatcaacaaaaaggatgtccactcagagaccccatcggaaagtcactgacttcaaagaccaaaggtagataaatccacgaagatggggagaaacaagtgcaaaaaggctgaaaatccaaaaaccagaatgcctcctctcctccaaaggatcacaactcctcaccagcaagggaacaaaatgggatggagaatgagtttgatgaattgacagaagtaggcttcagaaggtgggtaataacaaactcctccgagctaaaggagcatgttctaacccaatgcaaggaagctaagaaccttgaaaaaaggttagatgaattgctaactagaataaacagtttagagaagagcataaatgacctgatagagctgaaaaacacagcaggagaacttcatgaagcatacgcaagtatcaatagctgaaccaatcaagcagaagaaaggatatcagagattgaagatcaactcaatgaaataaagcaagaagacaagattagagcaaaaagagtgaaaagaaaagaacaaagcatccaagaaatataggactatgtgaaaagaccaaatctatgtgtgattggtgtacctgaaagtgatggagagaatggaaccaagttggaaaacactcttcaggatattatccaggagaactttcccaacctagcaaggcaggccaacattcaaattcaggaaatacagagatcaccacaaagatattcctggagaagagcaaccccaagacacataattgtcagattcaccaaggttgaagtgaaggaaaaaaatgttaagggcagccagagagaaacgttgggttacccacaaagggaagccaatcagactaacagcagatctctctgcagaaaccctacaagccagaagagagtgggggccaatattcaacattcttaaaaaaattttcaacccagaatttcatatccagacaaactaagtttcctaagcgaaggagaaataaaatcctttacagaaaaggaaatactgagagatttttgtcaccaccagtcctgccctacaggagctcctgcagtagtttctgctgccttttgttcagctatgacctgccaccagaggtggagtctacagaggtaggcagggctccttgagctgcagtgggctccacccagttcaagcttcctggctgctttgtttacctactcaagcctcagcaatggcgaatgcccctcccacagccagtctgccaccttgcagttctatctcagactgctgtgctagcagtgagcaaggctctgtgggcatgggacccgctgagccagggccgggatataatctcctggtgtgctgtttgctgagaccattggaaaaggtgggagtgtcccaattttcctggtagagtctgtcatggcttcccctggctaggaaatggaaatcccccaaccccttgcacttccagggtgaggtgatgccccaccctgcttcagcttgccttctgtgggctgcacccactgcccaaccagtcccagtaggatgaaccaggtacctcagttgaaaatgcagaaatcacccatcttctgcattgatcatgctgggagctgcagaccagagctgttcctatttggccatcttggttcttcactatagacatgttacaaaggaagatatacaagcagtcaacaagcatatgaacaaaaagatcaatatcactgatcattagggaaatgcaaattgaaaccacagtgagataccactgatcattagataaatgcaaatcaaaaccacagtgagatactatttcacacaagttagagtggctataattagtcaaaaaatagcagatactggtgaggttgcagagcaaagggaacacttatacactgttggtgggagcgtaaattagttcaaccattgtggaaagaggtgtggtgattactcaaaaagctaaaagcagaactaccatttgacccagcagtcctgttactggatatatgcccaaaggaatatatatcattctaccataaagacacatgtacatttatgttcattgcagcactgttcacaatagcaaagacatggaatcaacctaaatgcccatcaatggtagactggataaagaatatgtggtacatatacaccatgggatgctatgcagccataaaaaagaatgagatcatgtcctttgcaggaacatggatggaactggagaccatcatccttagcaaactaacacaggaacagaaaaccaaatgctgcatgtactcacttatgagggggagctaactgatgagaacacatggatgcaaagagacaacagacactggggtctacttgagggtggagggttggggagaagaataggatcagaaaaaataactattgggtcctaggctttgtacctgggtgatgaaatagtctgcacaacaaactcccatgacaggagatcacctatattagaagcctgcacttttacccctgaacctaaactataagtttttttttaaaaaaaatcttaagaaagaaacataaagtcaaacgttttgtgaatattatgtcaaaattatgtgcttatcattttgctgctgttccttttttaaaaatgctttttttatctctctgtaaaataatggtgttccctttctaatgcaaacatactttcagatcctaatcatcggggtaaacattctttttaaaactattgtttacaaaagtaaaaatctgactttgtccatgcagatcatctattgacaagtatttttcaacaacataattttaaccttatgacatcagttttaatagcagtcattacactattattccaggtgattctgggacacctgagtactctgtgtaattgaagttatctgtagccacatttaatatgacatgttcaatgtttggtctcacaagctcactgcttagagtcttcttcatccacccaatattgaagtaatgaaatggctgttaatagattcatcactgatctcattctgcgacatctttatcagaataatataaaatcaatgtaagaaatttggtgaaattatgaaaatttaggaaaaaataaatttcatttataaaatctgtgtgctttcattatggttttattctatttatataactcaaagtacatatattatgtttacataaaaattttttatctcattgcatgtatcttttcttctgacacaaaaattgtgatatttttctgttcatcattttgttccgtagtattcaacaatacctgtactatggctgacagtgtaatttaacattttttgataaaacaattgtaatgacatggtacacacattgtatacattttaaatcatttctcaatgtaaaatatttgaattgtctccagtgtttattttatgaatgtctgccacaaatattgaatctgaccatcgtgatttaggtgttctctgtatagtttcatatgagtatattatgaagccaatgtctatatgcatttttataatacttaatacttttccccaagtgtctgattcttttaaaatatgcaatcattatctgagaatctaatacataatggaaaagcaagaaaatttgtgacaaaaattattttatgtaagaaagaagtagaggacaggctgcacaactattgacctggattcgaacctaccttctgcaaatgaataacaacagctagtattagtatttatcactattgttctaatagtcattcttgcccttgtcttccttctccacctactctcttcccccttctaatggcaccatcactttcctctaatgtgaatgggaaaattttttgagaataaggttagagtgcatagaattttcattggtcttacctctgcctttgtcctttgggaaattaccacatagagcctatgcaattttcattcaacatagacattgagttttaactcaagtaagatttcagttttctgttgctgcttataagaaggtagacaaaaagatctcttaaggcttatataataaagtagtgaggaatgcttgctttctgcttatgtctcaaaagaataacattaaagtaaaatatatgaggttcttttgtttcttcgtaaggaagatcatcctatatcctgacagaattcttttgtaaatctcagtgtagttttcagatgcaagtggtagacattatttggatcttattatacatgcattgttcatttttttttggtgcttctctgtcaggcagctgtgatgatgagtcccaagtttcccagagatttttactgaggtgtcctataggcgtggcataaggcagaaaacattaaaaggttaaactgacccttttatgctctaagatataaacctctgtgatctcactgacgaaagttttaaatgctagagtgaaagcaagtaaacattggctttggctgagaatattctggtggcacacatttatgtcgttgatgaatagtgtaccttgaaaagccttaacccttacatcgttagcatttcatcttgttcatctgactgcccaaaaatctatatttaaacaagtccacaggggatctgttctctaggactttgctggagaaccttgatgtgttggaaaactgttcctattaatagaaaaattatatctcgagtggctggcatatgttaactaatggatactattaatagtaataacaaaaataaaaaatcattacaatattactactatttgaatcactatgtacgagagacattataagtgttttatctgtattaagtatattttcaacacaacacaataggaagaaattgccattattatagaagtaggcataattatctctatcaacattctagtccacttttccattatctgttgcataaactcatgcaaaatcttctaaatgatctacgcttttcacaatctggcctttttgtgatgtaatccattgacaacattgagagctttttaaagaaagggaatctgatcacatctctccatttcttaactctgtgcagtagctccccattgcccttaatagacacttcgatctccttataattatattgcttccacttacctctctagcaacatctgctactttactcagctttttcctgcatactaattagaaatcttaggaactgcctttacttcactacctgcttttctttttttgttttcctctccccctcttcttttcacctattcctgcacattactgaggactcactttaccaatgactttgagatctcttctagatgtttgcttagcattgtgaccttataacacttttagacttttcctttttacttgcttatagtctatctttcaaagtacaacgtaaggcatgagggagcagaaagtgcctacatttcttctctgaaaatcgagcacttatccatggtttatgctgatcacttcataaacattctttgaaggaatgacttatactttttttttactttgcacaatgaaggctttcattgaatcaaccctgttttcagagtctctttagtatccctctttgatatttaatgacactaaagtttacacagttgtgatgatatagaaacatatgagtttctaatggtaggtcactttactcgacctcccatattttctcttactgtgagtcaaacactctgaataaaaacatatctggccattccttctgaaatgcaaagcaaacaaatcaaacaggagtaaatttaccttaggcagggttttggctggtttacagtggagttcccccacaaaatcgacatttggtaagggtgggcaaagaaattcaaaatcccagtacgtttgaatgagccacacttcagctttccccattatctgaaataatgtacattaataaaataaatgtatacatatctttttatatataagcataacaattttcatatattgcatgttacttatatataaggaaagcaaagtgttcagataattaagaggaaattacatatttaatgtaacataagtatattcacaatcacaaatagttattgaaataagccactatggacttaaatatgcatttgtttcctctctaaagttgcagtagtaaccaatatagatttaaacagctctttgagctccacgattaattcatcttactatacttataaaaacagctttctacaaagcacaaaatctagtttccacaatttatcaagtcagtcccttgatccttggttctccaagtgaactgtgagttttctgagagtatggctgaaatccttgaacatactactgcttctagttcatgttaagattttaatgatattagttgtaaaatacatacatttaaaaatgatagctagtatatattcagaatttattgaaacagagatatgtgctcccccttaacttggcccatattttccctaataaagagaagtagttcaataaaatatagattaaaagcttgaatgttcactttcaacaaggtttcagttcacaaagcaaataatttccaagttgttagtgaactatgaacaaacactagaaacctcaaattttaggtttctgtttctgaaatagagccagtatacctctcaactgtgaaggaatccttctgtttatagagaaaaatattttaatacctaaataagaaaagtgaggtacacaaagagaaacaattttctcaatgctgcattaatagttatgctagaaatatgtgtagctcctcatctaaatgtctgccttcatcaagttgtttattgatatatgtattgccttttttaaagatgaaaaaagtatagtaaaatacttatatagttgcttaaagaaatcataagtgctttactttgtagttttttttttttaattcctgtagtgtcctataggagcgatggccaaagggttctagctgagcctataatatcaacatttctataatatttgtgagattgatagatcatcttacatttgccattcatcatttcatttaaacaacactatcttcttacattatatttatatacgctcaccttcaaaggcaaaaggaaagttagaacttattaaccattgattagaaacatgacttacctagaacttcactgtaaaacttctcccacttctcgtatcaaacatttgaaaccaaaagtcaaaataaagcacatgtattaaatttttaatcctctccacgaatgtcattttaccacttaattcagacagaacagcaggtatgcgggaagtggggaatagaagtcctccactatacttctcaagtgtgtagccaggagactgtcaacaaaggacatgtatttaacatgcctttaacatgctcagctagcagttcaccacaggcaccaagggcatctgcaagaacgacatcaaacattgactcttgtagttttgtcgtaattttcttgttcaaaactacatctttacagagattattaacacagtctgtagattcccaaaagagttcttgtgcttgtgagaaatatgaccaaaatgcatctttctgaagatcgtatatccatctattgatcagtttcacaacaagaccctcaaaattatttttaattagagatgttggataaacctcaaatctaatagcagatgatttactagggtgaataataatggaagccaaagatgacagcacagtcatcttatggcctctccaaacaagttcatccaggattgtctttatattcatccaatggctgtattctgtgggccacactagcacctttccacaactcccagaactaaagtgacaactgagttgtatcaggagaatatttgacatcgatttcatagttctcctggtgcaatgcaatgcttcttttcaaatcgctgtttctttctgtttttctcctacttatatctgaagataaatcaatcaagtgaaagtataactgctacaattcaaagtagtagttaccatataatttctaaattaccataggaattgtctgttaccatataatttctaaattaccataggaatttccagattgtttttcacagtggatgcttcaatttccattctcaccagcaatgtataagaattttaatttcttcccaaccttgccaacacttgggattatatttcgtttgattatagccagtgtgaatgaagtgatatctggttatgctttacctttctttgatatgaaatcatgttgagcatgttttgcctaattttggttgaattatttgtcttcttatggacttgtgtttttaatatctttctgatataagaaccttatcacatatatgatttccttgttttttttttattctttgggctgtccttttactttcttaacggtgttcattgaagcacaaaagtattgattttgatgaagtccaactaatcaattttaatttggttgcttttatttttgattttatatctcacaaaccatttccaagttacaaaaattagtacctgttatttattattagagttttatagttctagtgcttacatttaagtttttgatcacctttgaattagcttttgtaagtgatttgaggtagagggtcccaactcaattattttgtatatggataatcattattcccacttatatttgttgaataatctattctttcccccttaaatagttttgaaacttttgtcaaaaactttaaatgcatgggtgtatttctatattctaaaatccattccattgatctacatgtctatctgtaggcctgtatcacactctcttgattattgtatatttgtatttgtctttaaaagcaggaaatgtaagttttccagctcatttttattttaaattgtttcagttttttaaaaaatttttttcttcttgctttttttctttaagaggtagaggtgttactatattgcccagactagattcaaatttctgggctcaagcaatcctcccaacacagcctcttgagtagctggatttacagatgtgtttcactacacctagcttcttttggctattagtatgtctcttgaatatgtataaatttcagaatcagcttgtctgtttatgcaaagaagtgatctgggattttgatagggattgcattgatttggtatatgaatttggggagtagagtatggtaattatcacaatattaggtctttcaataaatgaagatgtgatgcctttctatttatttagatgttcttatttccacagcgttttgtagattttgttacagtggctagctagtcagacacaaacagggcagaagacggctcccacaccctaccaggaaagtcagatgaccatcagttaatggtcaggcagttgtcacactgtctcgctaaaataataattggttgcagccagccagagaaaggcagctttcctataaatagaaaaaatcaaatctggtaatcagcagcttcctgataagatctcaggagttgggtgagtgggctcacgcatgcacattaagaggccaaatggtggagtaagacattccggtggcaccagaaaagggaagaatgcctcaggggagcattcatatgactccagtaaacatactgtgcatactcatctcctaagtgctagcaggccatcacacataccagcaggtcaccctaaggaaagaatcaaggaaaatggaagcaggatcctggaagtatgccaacatataaaaccctaagtcaaaggtcaaacactgcactttaccttcaaaatggccacttggatataccccaagtgtactttcctttctttcctgctataaacctttttaataaattttcacttttgttctgaaacttgtcccggtctctttttttgccttgtgcccctcaatcaaattctttcttctgaggaggcaagaattcaggttgctgcagaaccacaaaaatttgctgcagtaaccaccactagtaataatttcacagtgagagttgtacaattttttgttaaacttattactaagaattatattttttcatggtattataagggtgattgtttaatcttcattttagtttaaatttccattgcaattttgtagattttttgttttcttatcttggatcccaaaatcttgttttattggtttacttgaatattttttagtggatttgtaaaaatttcctattacaagatcattatatatgccaatagagatagtttaacttctttctttctaatgtggattccttttatttcattttctttcttatttgttgactgaaatttctactgcaatattgagtggaagtgagaagagtcaatttagtgtgatgttagctgtgtattttttttttttttttttttttgagacggagtctcgctctgtcgcccaggccggactgcggactgcagtggcgcaatctcggcttccgcttcccgggttcacgccattttcctgcctcagcctcccgagtagcagctgtgtatttttttatagatactattgatcagttttaagatgttctcctttacttctagtttaagtgttcttatgatgaagagtattgaatttcattaaataagtttttctgcagttattgaagtgattatgcagttttttcctttattctaatgatatgatatactagttggctttttcagatgttaacataactttgcattcctggaataaaattcatttgtttatggcatttaagcttttcgtatgttcctgaattttctttgctagtgcgaaaggaaagtaaaaatcttgagacattaaactcactatgtcaaagagaaaagttaatcttgggaaacaaaccatgtaaaactggctcccattttgttcctaaacagataaatgcaaaaatagaaggccacatacctctccagagggcctccttcccaatttactcacaaggaaaatcacaaggtcctaaaacagagttctcttgacttttaccctgagagtataaattaacattttatatttgcaggtatataaaagacaggacttgaagccattgtgtggtttttagcataagggcttactgaatggtggttatgttttctcctcttttattttttggaggattaattattttaaatatttgatagaagtatagagctttgatattttctactctaccatttccagttattaccccactatttttttctaaataatatttcactggaagccatcagacactggcttttcttttatgggagactttttccttacagcttcaatcttgttacttgttattagtttgttcaggttttttatttcttcatgggtctatcttggttggttgtatgtgtccaggaatttattaatatcatctaggttttccaatttgttggtatatagttgttcataatattctgtaataatttgtgtttctgtaatctcagttttttgtctcctctttcacttctgattttatttagtgggtctgttctcactttttccaacttagtctagctaacagtttgttgattttgtttacttttacagagtttaccttattgtctgtggctgcttttgtactacagtggaagagttgagtaggaacaagagtctaaagggtttgcaaattccaaaaatatttaccatctgaggctttatagaacctattctgatctctgcaggttcattttttcctttaacctttctatatattcaatatatatttctatatatttctgtattactatatattcaatatattctatatattcaatgcaattttaataaaatagtatagatttttagtgagtcagatgatttatgtttaattatgttaataatgagttaataaattaatttgtatttccattttatttagaataggtgagtttgtttgttatgtggaatggtgcttctgttttaccttttttttgagaaatctctaaactgctttccacagtaattcaactaatttgcaatccaccaacagtatataagcatttccttttctctggatcctcactagcatgtggtattattattaatttatactttttagtaatagccattatgactagtgtgagatggtctcattgtggttttgatttgcatttctatgatgattagtgatgttgagcatttttgtcacgtttgttggttccttgtatgtcttcttttgagaagtacctgttcacatcttttgcccggtttttcacggggttacttgatttttgcttgttgaattattcaagtttcttatagattctagatattagacctttaacagatgtgtagtttgctaatatttcttcagtttacatctcacttgtgaattttgagttttgttgcaattgttattaaggacttagttataaattctttcccaaggctgatgtctagaatggtatttcctagattttcttcaataagtcttatagctttaggtcttatatttaaacatttaattcatcttgggttaatttttgcttggtgaaaagtagagatccagtttcattctttttcttatggctagcaagctatcccaccatcatttattgaatagggagtccttttctccattgcttatttttgttgactcagtgatagatgactataggtctgttgctgtatttctgggctctgtattctgtttcattgatttatgtgtctgtttttgtaacagaaccatgctgttttggtgtctgcagccttataacatagtttgaagttgggtaatgtgatgcctctggctttgttctctttgctgaggcattcttcagctatttggactaatttttggttttatggaaatttttgaatatttttttctaattctgtgaataatgacattggcattttaataggaatagcatttaatgtgtggatggctttggttaggatggttattttaatgatattgattcttccaaccctgagcataaaatgctctaccatttgtttgagtcatctatgatttatttcagcagtgctttgtagttcttgtagaaaacttttgtctccttggttagatgtatttttaagtatattttgtttgtgtgtgtggtataaatgtgattgtgttcttgatttgactcttagcctgaatttttattggtgtatagaaatggtattgatttttgtacatggattttgtatcttgaaacattactgaagtcatttttcagttctagcaggctttaggcagtctttaggattttctaggtatagaatcatatcatcaccaaagaacaataccttcaattcttttcctatttggatgccttttatagctttctcttgcttaggtgctcaattaatacattattgaaatagaaagtgctgtcattttaatcatttatatttgaaatataaaattttaaaaatttatatttgaaattttaatcatttatatttgaaacataaaattttaaaattttaaaattttaaaagatttggactatgttaagtccaaattcattgcagaaatgtacttatccatttaataataataatagttatagcaaattgaattttgctatatacagcaattacatacagcaactcttttagtctcagcaatgctattaagtaggtagtgacattgcttcatctacatttcactgaaggagaatgtgaggcatagacctgataagtaatttgcttaactatacatgattctgtaatggttttgcaaagatgatataggttatctggattcagagtgcaagctcttacccaccatcctatgctgactactctttctgggttacaggtagttacaaaatgtaatatagattcactttttttgtaggtatatattaattttaatattattacaggagtataactcaaatatgtaaaaatatttttctggttgtctatcactgcttaaccaactgctctgaaatgaaggtgcttagaacagcaacattttatcatcatctgttttaattctaggttgttggccaggctcaattaggtgtttatggcacagcatttctcagttggttactgtcctaaggtagcttgggctaatcatctgaaggttaatcactcacatatctggtgattagtattaaaagtctcaagctactgcagtgctgggccaattgtgacttattaggcatacatatgtatttctacaccaaatggtatatttctcctggggactgtggatatagcacagggctccaaagcgagtggagagacagagaaaaaggaaaaaagaatgacagaaacacagagaaaaggacagaaggacagacagagaaaatgtattaacaatttttttgagctttggaagttaagctcctcacttccactatattctcttttttgagacagccacaaaatttgctaaatttcacaggaagggtatatgacttgatgagaggattgccaatgcatttgtaatcacatctcaaaattactgcaaatataaccttaaaaattagaagaaatcactaaactactgtagaattcataaaatgttgacataagacattaaaattttaaaaatttgtttgctaaaattttagccataattaaaaattttaattaacattctaatatatttattaataaatatttaaaatatcaagtaggtgtccaaaaacaggctgtaaatttatcagatagagagcaccggattgctggtcaatttaagttttctaaatggcactaatggattgataatattatattaaaacccaagaacatgctatctcaaatcaatgtttatttcactaattaatttttaaaactatataattaatatataaaaacaaatttgtgaaaggttagtgaatgaagtatatagaatcaaaattaaaagtagaatcctctatgtttatacagatttacagattcttaattttatttcaaagaagaatatcatacttttttttctggaactttttttcatttagcaatgtgatgtggagagcattccatgatattgtctgtaatatgcctgttctctgtaattgctgcataccttctactttttgtggtaggtatgtatgttcattgactgatagccaggcaagtgatggagggaacatcctgtacatacatgcactcaggtgcaagtatatctggatggcagatgactagatgtagaattgcagagtcaaactgtatgtttaattttttttgtaagagttgtttcactttatactctctcacaaactcttttctcagattcttatgtttgatcaatctcctgtgggaaaataattcgttgactttttatggctacatagtaatccatggtgtatacatactgcactttccttattcagtctaccattgatggacatttaggttgatttcatgtctttgctattgtgaatagtgttgcaatcaacatatacatgcatgtgtctttataatagaatgattatattcctttgggtatatacccagcaatggcattgctgggtcaaatggtatttctgtcattaggtcttggaacagacaaccaaatgctgcatgttctcacttacaagtggaagctaaatgatgagaacacatggccacacaggaagctaagtgatgagagcacatggaacacatgaacaacacacactggggcctcttggagggtagaaggtgggaggggggagaggatcaggaaaaataattagtgggtactaggcttaatacctgggtgttgacacatatttacctatgtaacaaacttgcacatgtacccctgagcttaaaataaaagttaaaataaattcattgacttaaggttattgacttactaaattataatgtccaactttctagtacaagtagccatctttttgatgtgattggccatttttacttctgtgaattgtcaattcatatccttcatctattttcatattggtctgtttgtctttttggttggtgatatataatagctctcactatacaagagataccagtcctttatctatgtgttgcaggataagcttgatgtaaattactttaggtttgtatgcatgatttagcaatattatctactatgacactatattcattcaatttttcttaaaaatgtttcatttatctagatacattttataaaaatgttgctgcaatctcttccaataattcccttagcatcaaaattttaatttatttttagaatacattcatgccataggtcatagagtggttattgtgagacttggatgatggtcttcttaccaataaagacacataggtttgtgttaacccatactactttgatcataaagtgtttccttgatgtgtagcttttaagagggccttgagaattcctgagattttattatttgccaatttttggtaatttttgtggtcttttaattgttactgattatgattagttgcaatatgcttacattttaaaaaatcattatcctatttttggtcatgctaaatgacttatgttttcatattagtgttatgggatgaatagagttacaggcttctgaggaaagagagaaacatgagacatccttatataaaatagggttatatagaataattatcatttttaactgtcttctacaaacacattcagtttcacaaacatctgtaaggcagctcaataattctgtgccttgttttggaagaagtgaacacatatatacatgtacatttgtgataatcaaaatcagtaagtccccttaaagtgctggttttatattatcacaacctacaattcagacattttatccaatattaaagtttaaaaatgaccgtgaaagcaaccagttcacactttagaaaagttcatggggaaaagagaattagcttgtgaacaaaggttttcccaaatagttaaattttgtagtatttgtcaggtaggagtcattctatctctaatttgttgttctccaactccaagtctctgagtcccattattttgctcttcaggccctgaatttggcataaagtgtagtagaggcggacagtgtcgtctcctgtgcatcactgttgctttgcgaagaaattctcaatgtggtcagctgctgctgctacagaagtcgattttctttaaacactgccaagaacatctgacttacatagtatattttgatttgatatttattcaaactgagcctgctttttttctttttacaaactctctaaaactgctaaaagtcttcactttataaactatgtaattaccatgatctttatactgttggtaaagcaatggttcactttccccatgtctttcacctcagttcttttctcccctgtgtgaattgtatccattttgttcaaagtgattttactgaataccaggagttatcacctctcaagtgttattggcaatgagattgtttttgccagttatcagtgaattattaaattccaaagtcccttgttgagggtctgctttttagtgccacttgcccaagctgccatagtctatttttctcagaaagcaaagcctgagataagaattagtgtgcaataacttaatttgagaaatgttcttagggtacaggagtaggggacaggaaagggtgaaacaagaagggagaaaagtcagtacaagaatgtgttaccaaactaatcatcaccataactgttgggactaaagctcatgcggacccagtaggaagttgtgtggatgtaaagcgtgatcattaaccatcactttctattgctcacactgccaggttatgcatatgtgagtgagtgctagctgagtttcttcgagggttccatgaagagatgttaaagaagtctggtgcagaaaatgagagacctgtcctatcagaagacgacttcacaaagctccttgacacagcaaaggctagagaaaaaaaaattagctgaaaaaatatggggtgcaacctaatttgatcaaatgtattagagctttcttttttcttttgtttcattttcacagtatattacttttcatatgattaaatactgtaaattttctcaggtttctgataaagttatgcctgtgatacaggagctagaaagaaattatttaggcagatagtgagggtgaaagtccttggtaaggttttgttttaataaaaagcagccccccaaatcatttccttgctaacaaaaagcagccagaaaaatcaagcttcaaacctagataaacaagctaaagcttgcataggtaaatgctggcaactgtgccagtaattcctcaaggatctagaactagaaataccatttgacccagcaatcccattacttggtacacgcccaaaggattctaaatcattctattataaagacacatgcacacgtatgtttattgcagcactattcgcagtagcaaagacttggaaccaacccaaatatccatcaatgttagactggataaagaaaatgtggcacatatacaccatggaatactacacagccataaaaaagataagttcatgtcctttgcagggacatggatgaagctggaaaccatcattttcagcaaactaacacaagaacagaacaccaaacaccacttgttctcactcataagtgggagttgaacagtgagatcacatggacacagggaggggaacatcacacactggggcctgttgaggtgtggtggactaggggagggataggattaggagaaatatctaatggaggtgacgggttgatgggtgcagcaaaccactgtttcacatgtatacccatgtaacaaaactgcagattctgcacatgtaccccagaacttaaagtataattaaaaaaaaaaaagaaagaaaagggatgggataccttgaagccaggtatattcaacatggatattcaacgtggaggtcccctctttccttttctttgtcaaccatatgtgcagtaaagaagcagcaacatggcactggccatgtagagaaaccatttgcttattgaaaattaaggtggggcagacagcttcttcttacactatgtaaatggcacacctggttccaccaatcctttgtgccctatataaatcagacactgtttcctcaagctcatctataaatccctgtgcatttcaccatgggactagaagatccattcgggagcacctttctgcagaaatgagagctattctcctttctctttctttcccctattaaacctccattcttaaactcacttctcgtgtgtccatgttttcagtttccctggagtgagatgatgagttttgagtatttaccccagacaatgatgctgcttaacctgttacttttatttattcttatttttaaaatttttatttattttttatttattttactttaagttctgtgatacatttacagaacgtgcaggtttgtggcataggtattcatgtgccattgtgatttgctgcacccatcgacctatcatctaggttttaagccctgcatgcattaggtatttgtcctaatgctttctgtccccttgtcccagaccccctgacaggccctgatatgtgattttcccctctctgtgtctatgtgttctcattgttcaactcccactaatgagcgagaacatgtagtgtttggttttctgttcctatgttagtttgctgagaatgatggtttctatccatatccctgcaaaggacatgaactcattttttatggctgcatagtattccatggtgtatatgtacacattttatttattcggcctatcattggtaggcatttgggttgtttccaagtctttgctattgtaaatagggctgcaataaacatacatgtgcatgtgtctttatattacaatgatttttaatcctttgggtatatatccagtaatgggattgctgggtcaaatggtatttctgcttctagatccttgagcaattgccaaaatgtcttccacaatggttgaactaatttgcactgccatcaacagtgtaaaagtgttcctatttctccaaatcctctccagcatctgttgtttcttgactttttaatgattgtcattctaattggcatgagaaggtatctcattgtggatttaatttgtatttctctaatgaccagtgatgatgagctttttttcatatgtttgttggccacgtaaatgtattcttttgagaagagtctgtttatagcctttgcccactttttgatggtgttgtttttgtcttatatatttaagttccttgtagattctagatattagacctttgtcagagggatagattgcaaaaaattcctccattctgtaggttgcctgttccctctgatgatagtttattttgctgtgcagaagctctttagtttaattagatctcatttgtcaattttggcttttgctgcaattgcttttggtgttttagtcctgaagtcttcgcctatccctatgtcttggtattgcctaggttttcttctagggttcttatggttttgggttttacatgtaagtctttaatccatcttgagttaatttttgtataaggtgtaagaaaggggatcagtttctgttttctgcatatagctagcaagttttcccagttttcccgttgcttgtttttgtcagttttgtcaaagatcagattgttgtagatgtgtggtgttatttctgaagcctctgttctgttccattggtctatatatctgtcttggtaccagtaccatgctgtttttgttactgtagctttgtagtacagtttgaagtcaggtagagtgatgcctccagccgcttttttttgttttgttttgttttgttttgcttggggttgccttggctatacaagctcttttttccttccatataaaatgtaaagtagtttttctagttgtgagaagaaagtcaatggtagcttgatttgaatagcattgaatctataaattacgttaagcaccgtggccattttcatgatattgattcttcctagctgtgagtatggaatattttttcatttgtttgtgtcctctcttatttccttgggcagtggtttatagttctccttgaagaaatccttcacgtctctttttagccatattcctaggtactttattctctttgtagtgcttgtgaatggaagttcaatcatgatttggctctcagtttgtctattatcagtgtataggaatacttgtgatttttgcccattgattttgtatttggagactttgctgaagttgcttatcagcttatgaaatttttgggctgagatgatggggttttccaaatatagaatcatgtcatttgcaaacagagacaacttgacgtcctctctttctatttccataccctttatttctttctcttgctgattgccctggctagaacttccaatacaatgttgaaaaggagtagtgagagagggcatccttgtcttgtgccggttttgaaagggaatgcttccagcttttttgcattcagtatgatatgggctatggatttgtcataaattgctcttattattttgagatatgttccatcaatacctagtgaattgggagtttttagcatgaaggtgtgttgaatttatcgaaggccttttctgcatctattgagataatcatgtggtatttgtgattggttctttttatgtgatggattatgttcattgagttctgtatgttgagccaggcttgcatcacggggatgaagctgacttgattgtggtggataagatttttgatgtgttgttagattcggtttgccagtattttattgaagatttttggatcaatgtccatcagggatattggcctgaaattttcttttttgttgtgtctctgccaggctttggtatcagcatgatgctggcctcataaaatgagttagggagaattccctctttttctgttgtttggaatagtttcagaaggaatggtaccagctcctctttgtacctctggtagaattcagctgtgaatccatctggtcctggactttttttggttggtaagctattgattattgccacaatttcagatcctgttattggtctattaagagattcaacttcttcctggtttaatcttgggagagtgtatgtgttgaggaattcatccatttcatctagattttctagattatttacatagacatgtttatagtattctctgatggtagtttgtatttctgtgggattggtggtgatatcctctttctcattttttatttcatctatttgattcttctctcttttcttctttattagtcttgttagccgtcgatcaattttgttgatcttttcaaaaaaacagctcctggattcattaattttttgaagggctttttgtgtctctatttcgttcagttctgctctgatcgtagttatttcttgccttctgttagcttttgaatgtgtttgctcttgcttttctagttcttttagttgttatgttagggtgtcaattttagatctttcctgctttctcttgtgggcatttagtgctataaatttccctctacacactgctttgaatgtgtcccagagattcttgtatgttgtgtctttgttctcattggtttcaaagaacatcttgatttctgccttcatttcattatttacccagtagtcattcaggagcaggttgtttagtttacatgtagttgagtggttttgagtgagtttcttaatcctgagttctagtttgattgcactgtggtctgagagactgtttattataatttctgttcttttacatttgctgaggagagctttacttccaagtatgtggtcaattttgtaataggtgtggtgtggtgctgaaaagaatgtatattctgttgatttggggtggagagttctgtagatgtctattacgtccgcttggtgcagagctgagttcaattcctggatatccttgttaactttctgtctcgttgatctgtctaatgttgacagtggtgtgttaacgtctcccattattattgtgtgggagtctaagtctctttgtaggtctctaaggacttgctttgtgaatctgggtgctcttgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggcagatcttcctccatccttttattttgagcctatgtgtgtctctgcatgtgagatgggtttcctgaatacagaacactgatgggtcttgactctttatccaatttgccagtctgtgtcttttaattggagtatttagtccatttacatttaaagttaatattgttatgtgtgaatttgatcctgtcattatgatattagctggttactttgctcattatttgatgcagtttcttcctagtcttgatgggctttacattttggcatgattttggagtggctggtaccagttgttcctttccatgtttagtgcttccttcaggagctcttttagggcaggcctggtgatgacaaaatctctgagcatttgcttgtctgtaaaggattttttttctccttcacttatgaagcttagtttggctggatatgaaattctgggttgaaaattcttttctttaagaatgttgaatattggcccccactctcttctggcttgtagagtttctgctgagagagctgctgttagtctgatgggcttctctttgtgggtaacccgacctttctctctggctgcccttaacatcttttccttcatttcaactttggtgaatctgataattatgtgtcttggaggtgctcttctcgaggagtatctttgtggcattcgctgtatttcctgaatctgaatgttggcctgccttgctaggttggggaagttctcctggataatatcctgcagagtgttttccaacttggttccattctccctgtcactttcaggtacactaatcagacgtagatttggtcttttcacatagtcccatatttcttggaggctttgttcatttccttttatacttttttctctaaacttcccttctcacttcgtttcattcatttgaccttccatcactgataccctttcttccagttgatcacatcggctcctgaggcttctgcattcttcacgtagttctcgagccttggctttcagctccatcagctcctttaagcacttctctgtattggttattctagttacacattcgtctaaatttttttcaaagttttcaacttctttgcctttggtttgaatttcctcttgtagcttggagtagtttgatcgtctgaagccttcttctctcaactcatcaaagtcattctccgtccagctttgttccattgctggtgaggaactgtgttcctttggaggagaagaggtgctctgctttttagagtttccagtttttctgctctgttttccccccatctttgtggttttaactacttttggtctttgatgatggtgatgtacagatgggtttttggtgtggatgtcctttctgtttgttagttttccttctaacagacaggactctctgctgcaggtctgttggaatttgctagaggtccactccagaccctgtttgcctgggtatcagcagtggtggctgcagaacagcagattttcgtgaaccgcgaatgctgctgtctgatcgttcctctggaagttttgtctcagaggagttcccggccttgtgaggtgtcagttctcccctactggggggtgcctcccagttaggctgctcaggggtcaggggtcagggacccacttgaggaggcagtctgcccattctcagatctccagctgcgtgctgggagaaccacttctctcttcaaagctgtcagacagggacatttaagtctgcagaggttactgctgtctctttgtttgtctgtgtcctgcccccagaggtggggccttcagaggcaggtaggccttcttgagctctggtgggctccacccagttcgagcttcctggctgctttgtttacctaagcaagcctgggcaatggcaagtgcccctcccccagccttgttgccatcttgcagtttgatctcagagtgctgtgctagcaatcagtgagactctgtgggtgtaggaccctccaagccaggtgcgggatataatctcctggtgcaccgttttttaagcccattggaaaagtgcagtattcaggtgggagtgacccaattttccaggtgccatctgtcacccctttctttgactaggaaagggaactccctgaccccttgcacttcctcagtgaggcaatgccttgccctgcttcagcttacacacagtgtgctgcacccactgtcctgtgcccactgtctgtcactccttagtgagatgaacccggtacctcagatggaaatgcagaaatcacccgtcttctgtgtcactcacgctgggagctgtagactggagctgttcctatttggtcatcttggctcctcctcctaattcttgaagatttcattggctaaagtaaaacaaaaattctgctcaaaatgaagccaaaatattttgagtatttgcaaaacaatgttgatactatgagtggagttcttaatgttgttgtgttcaaatacaatgtgtgaaacataatgaagctcagtaactttcgtgtgtaacttttggattagaataataaatatcaatataagcccataaggttttatattatttttatttttcttttcttttttttttatggcttggatgacactttattttcagatccaatactagaagttgtttccatgttcacattttccttcctggtttaaaaaaaagagttgtatttttttttttttgctttttttaaattatactttaagttttagggtacatgtgcacaacgtgcaggttagctacatatgtatacatgtgccatgttggcgtgctgcatccagtaactcgtcatttaacattaggtatatctccaaatgctatccttccccccattgtatttttcatagcttaaaaatcattgacatagaataattccagctaaagtacgtattaaatccctggaaaataaattttgtcttaacaaggtaagttgtgaaaagatgttttgtcacaggaaaaaggaaatcctccatttaaaaccctccatgctgaaataaaggaggagtcccatctttcagtcattccacttcaggcttttgatataactaatctcttttcttcttctttccttttttggcaagctttcggaaacaaaacaggcaaaattttgtgatgataaatatcacagttgccacgcaggccagcaggaatgctatcacatccaaagagtggtactggatccaggtgaggttgtgagctgcgactcgaaggtgcttggctcctttgtggcgcatgacaaactcaatccagaagactgctcgatccaggggcttcattggttggtcatgatgaattcttgataatttcatgacattctctttatagctgaaggataaatataaagatatcaacattaaaagtaaatttattgcttaagcatatcaagtctatggatggtctttgaaaagtgtcacacaaatgattgaaagtaagtgtcactgaattggcatgaaatttcaatgttttaattcatgtcattacagaaagtttggtttttaaattggagttttatcactgacaaatacctttaaaaatgaaaaatggaattttcggtgggaaagttaatgttttctggagcagaaaatattatgagccattctaagtgctataagtaagatagtggaaatggaatttgagaatgatctttttgatctttttaatttttttttattttttgagacaggcttttgctccattacacaggctgagtgcagtcacatgatcatggctcagttcagcctttctctttcggtctcaagtaatcctacatctcagtctcatgagaagctaggactacaactgcacaccaccatgcctggctatatttttttattttttacacttttagatatgaggtgttgctgtagtgcccatactggtctggaactcctgtagtcaagtcattctcctgcctctgcctcccaaagtgttggccctacagacatgaaccactgtgcccagcccattttgacgtatttaaagaagaattgtgacacaactggtgaaatgcctcctaactagtttctcagcttctactctaatcttttgtcttctaccatattttccttctagtagccagaatattttccaaattaatatcaaattatgacactcacctgttaagatttccatctggtttcttgttacattaagaataaattccaaatctgtctttggtctagagaactctacacaggcacctacttgtcctagccctttccccctgtacactttcttctagagacaatggccttcggtttttctctaaactcctgaaggtgttctcaccttagcccctttacaccttttgttccccgtgtctctctcattgagcattctttcttgcaactacttgaggtttgcttctatttctttttgaggcttccccttgtatgatacctcttggagagtcttttcctggccacactataggcacccataggatttctctagtgcttcatgcttactttgctatttgatttctggaactttaaaatatgttgtatatcttctacagtaaaacttcaagtatgaaatacataggataaatgtatatatactatgtgactacctcaaaattttaagattatcttaaacattatcccaaagtgaagacaccaatttatcacaaactgcatagaagaactctctcctcctgggccattttagtcactatttttatcctcaaagtaagtattaacctgatttctgatatcatagattagtattgtttatataattgaattaaataatacatattcatttctgtttttggttagcagttgtttaatagcattggtgtagagagtattcagttgattgacaaagaccacagatgatctcttcattttgtgattaatggatatttgtgttgttaacattttttgaccttactaataattatggtattaagatatttgtatattttattaggtttaaatatttattcatttttgttggatgtatacttggaagaatagttgatgagagaaaggcacatttataattagaattttttgttgactgaattttttaaaaaatattttttattttaaagaatcagattgttttcagttatcgtttttggatgatttataatttatttctagtatgactagaacatataatttttatgaatttgaatcttatacaatttacttagtgtttatttatggcccagcatatggtaaattcaggtaactatttcatataatctttttttttttttgagacagagtctctctgtcacccaggcttgagtgcaatggagtgatcttggctgactgcaatttgcatctcctgggttcaagtgattctcatgcctcaatctcccaagtatctgggactacaggtgctcatcccctacatctggctaagttttgtattattagtggacacaggatttcaccatgttggccaggctggtctcttaactcctgacctcatgtgatcctcccactttggcttcccaaagtgtcgggattacaggtgtgagccaccacacccggtctccataaactcttttaaaaatgtttattttctgtctacacacacacaaccagagatatatgtatggatacatatatacagataaatgtgcaatatatatacacacacacatatataacacatagattacatttaattgtgtacttcaaatgttttatctccttaaataaaatatttcaaagatcactattttgtcttttctttttggtctgcttaaatttaatgtgagtactggtaggttcacttttttgtttttttgcttttttgtttttttttgagatggagtctcgctctgtcaccaggagttcagtggcactatctcggctcactgcaacctccgtctcccgggttcaagtgattctcctgcctcaacctcctgagtagctgggactataggtgcacaccaccatgcccagataatttttgtatttttagtagagacagggtttcactatgttggccaggagtatggtctcgatatcttgacctcgtgatctgccctcctcagcctcccaaagtgctgggattacgggcgtgagtcactgcacctggtcagttcaaatttttttaaaaagttttatttttactttaagttccagtatacatgtgcagaatgtgcaggtttgttacatacgtatatacgtgccatggtggtttgcagcaccgatcaacctgtcatctagattttaagcccctcatgtattagctatttgtcctgatactctcactccccttccatcccccggtgtgtgttgttcccctccctgagtccatgtattctcattgttcaactccctcttataagtgagaacatgtggtgtttggttttctgttcctgtgttagttgctgcggataatggctttgcatttcatccgtgtccctgcaacagacatgatctcattcctttttatggtgcatagtattccatagtgtacatgtatcatattttctttatccagtctatcactgatgagcatttgggttggttccatatctttgatattgtagatagcgctgcaatagacatacatgtgcatgtgtctttatagtagaatgatttatatgcctttgggtatatacgaagtaatgagattgctaggtcaaatggtgtttctggttctaggtctttgaggaatcaccacactgttttccatgatggttgaactaacttacattcccgtcaaaaatgtaaaaagctttcctatttctccccagcttcaccaggatctgttgttttttgactttttaatcatcgccattctgactggcatgagattgtatctcattgtggttttgatttgcatttctctaatgatcagtgatattgagcttttttcataagtgtgttggctgcataaatgtctttttttaagaagtgtctgtttatatcttttgcccactttttgatggtgttgttttttttttttttttgtaaatttgtttaactttcttgtagattccggatattagacctttgtcagagggatagattgcaaaaatcttccctcattctgtaggttgcctgttccctctgacgatagtttattttgctgtgcagaagctctttagtttgatttgaccccatttgtcaattttggcttttgttgcaattgcttttggtgtttgtgtcatgaaatttttgcccatgcctatgtcctgaatgatattgcctaggttttctcctagagtttttatggttttgggttttacatttaagtctttaatccatcttgagttaatttttgtataaggtgtaaggcaggggactagtttccgttttctgcgtatggctagccggtttctccagcaccatttatttaatagggaatcctttccccattgcttgtttttgtctggtttgtcaaagatcagatggttgtagatgtgtggtgtttttctgaggcctctgttctgttccactggtctatatgtctgtctttgttccagtactatgctggtttggttactgtaaggtgtaaggaaggaatccagtggcagttttctccatatggctagccagtttttccaaaacatttcttaaataaggaatcctttccccagttgcttgtttttgtcaggtttgttaacaatcagagggttgtagatgtgtagtgttatttctgaggcctatgttctgttccattggtctatatatctgtttggtaccagtaccattctgttttggttatgtagccttgtagtacagtttgaagtcaggtagcatgatgcctccagctttgttctttttgcttaggattgccttggttatatgggctcttttttgtttccatatgaaatttaaagtagtttttttctaattctgtgaggaatgtcaatggtagtttgatgggaatagctttgaatatataaaatactttgggcagcatggccatttttacaatattgattctttttatccatgaggatggaatgtttttccatttgtttgtgtcctgtcttaattccttcagcagtggtttctagtcctccctgaagaggtccttcacatcccttgttaggcatatgcctaggtattttattctctttgttgcaattgtgaatgggaatttattcatgatttggctctctgtcaaatcatgtactgtcagtgtatagtaatgcttgtgatttttgcatattgatttttgtatccagaggctttgctgaagttgcttatcagcttaaggaattttggagctgcgacaaaggggttttctaactatagaattatgtcatctgcaaacagagacaatttaacttcttcccttcctatttgaataccctttatttctttctctagttcacatttaaatccagcatcttattctatatatatatatattttaattttctaacctgttttatgtttctttactttcttactttttttgaagtatcttaaatcatttcttgtcttactaattttttggtaaagtgtttttaatgtattcccttagctggtaccacctaacctcataataatattggtaggagtaatagactctgaattgatggtagctggtctaggcacagcatttttcatagtatttcctttggattatggaaaagttaagtattacatatttattttatcaacattgaaacctttgtatttcaaaaggcatcttccaaaaagtaaaaaaaaaaatctatctgtccatagtggaagaaaatatttgaaaatcacatatttgataagggattgtatctataatatataaataattcttatgaatccataagataaatagaaaaagacaaaatattcacaagattaaaatagaaatttatctaaggaagatgtgtgaatgaccagtaagcacatgaaaagagggttaacatcttcagccataaggaaatgcaaatgaaaaccataatgagagaccactttacacacactagaatggctgtaatagaaagacaggtgataacaagtgttgggaagagtgtgaagaaattagagccctcctatccagctggtggtaatgaaaaatgatgcaaatactttgaaaaacagtttagcagttcttcataaacaacaatttcccatatgtctcagcaagtccactcctagcatctcctcaaaagaagtaaaaacatatttttacacggaaaatatgtataacaatgttcataaatgccaaaattggaaagacctaaaatgtccatgacctgataaatgggtaattttggtataaacatatcaaagaatattatatagaaataaaaatgaatgagttctgatacatcctacaacataaataaaactaaaactaattatgctaagtgaaagaagtcatttatgaaacaccataaattgtatgatttcatttatataaaatatgtgaagagaataatctattgagaaacaaagtaagatggtatttttctaggactagaggtttattgggagtgacttcatacattatgagtttaatttgaattcattaaaatgttctttagggctgtggctttgtaactatgtaaacatactaaatatatttagattttaaattttagtgaatgttatgctatgcaaattataattcattatcacatttcttaaaataatgataataaaaataaatttttgagaaagaatagattcatactttcagaaattttaggtattgaattgaaatatcatatttctctagttatgttctttcttttcattgtgcattctatcattaaaaatatttaaaataattatctacatatctttaatttttttgattttataattcattgcagtcattggtgacccattaaatctgtggggttgaaatgtaactttgaaataaactgtctggtggaaagtaaggacagattttacattggttaaatcacttcaatcccttcaaaattagtctcttaaaaacgggttaaaattcatattcactgttgacaaaataatttataaataccacctggtcacaaaactgtaatactcacacagggtcattaatgactgacttcaatgcattgagcaaatctctacttgacatggtcctgatgtccacactgagggctgctcccttggctttcatgtgagcaatgttatcatgttgatccgcaaacaagggaatgcccaccatagggatcccatggtagatcgcctcatagatgccattggttccaccatgagttataaaagctttggttttgggatgacctaaaagtggatgcattttaacaaaattattaattacaaggtatgagaattgaataagaaatgcacaatataaggaacttaaagcaaaactgttccctaggtaacattatacccacaaaactgcattgaaattgttttcaaatttcagaagaattgccaggtgaacaaaatgaaaaagcatattcttaattaaaaaattaaaatgtgcaaaaaaaagaataagattgggtatacaagaacgtggtcttttaagtattataaataatgaggtcacatttacatatttaaaaaatatttaaatacttaaaatatttaaaatatttaattttttttaaaaggcagcagggagtagggtggaggtggggctgaggaaggaccagttatgcatcatcatgaaatgtgttatcattttatcatgataaagattggttatttattcccataaaaagtagagtcactggtaatagaaaagtgtccgctatttttcagtgcctgttgaaataaccctgcagtaggggaaagaacagaggtaaagctgcataaataggagacagacagaaaatccaggatgttatttaaaacctgtgagaggaaattacacctgaacaaagagatttttattctgaccataaagaatgtgactgtatgtaataaaatgccaactactatagtgcattctttttatactaagactggaaaataaatataaagtagttaaatttgatttgttttttagttttccaataataaatgctaaatatgtttgttttatgttgaactattatcactccaatttgctgttactaatatattcactgtttgttctccagaatcttaccaagaaggtcattctggggtaaccacttgtacagtcgagtattggaacctaaagtatttggcttcttgccatcaaatctccatagaacctgttagggcaaggaaaatatcttgttcaatgaatagaactctaaaaacatagcatgttagaattctgaagagattaataatcagttagttaatccatataaaagatgaagaaataagaagaagtgatgtcaagtaatgagaactactaaaagtttgaggtaagttgaatacccacgtttaatgtcgttacttttataatcaattttgtatataaagaaataatgacatttctaacataatagctagacacatgagattgtgaaaggaaaataaatcttggcaacccaaactctatgctaaagggaaaagttaagctgcttagggcaaacctacctcccattctattcaaagtcagcccttgactcactgagataaatgaatatcaaattgcctcatttcgagaggctaatcagaaactcaaaggaattcagctatttgtctctcatctacctatgacctggaagccccttccatgcttcaagttgctctgcctttgtttctagctgtcccccatttctggaccgaacaaatgttcatcttatatatgttgattgatgtctcatgtatccctaaaatgtataaaaccaaactgtccccccaccaccttggacacatgtcatcaggacctcctgaggctgtgtcatgggtgcacattttcaaccttggcaaaataaactttctaaattatctgagaactgtctcatatattcagggttcatattttggtaaccatgaagagattctgagtggaggttccctgacctttgataaatgtcctatcagtgcttggtaccagcatgagctaaatttatggctcaaacaaagaagacaattggctgaggtctgggagcaacccctccagagaatctctgataccccaaaattcagacaagatctgaagtttattttgctgtacaactcctttttgttttttttggagttttacttgcttcctacaagaaaggcaagatttcctgtttccatgacaatggaaggcaggtaactctatggagtttgagctcgctcccaggagggaggatgaatttgaggtttctttcctgattctaggatggcagagggcagttttggcctgaaacccatccgtaggtaaacagctgaattgcggttttgtcttggttaatgtttaacaactagctggacttaatttctccttaccattacagtgcttagtgatcacatttctgggattttttttttttttgtacattccagtatttctcccatcagatttgatgaactttacctgacttgatcaaatctgagtgagaattccaaattgtgggtaacaaagcctgtctaatttggctaaaattctttgcagacgcaaaagagaaaacaaaacaaaacaaaacaaaacctaaaaaccatgctcttggtttctgtgtttgcttcctgtctttaaaaaaacaaatgttcttttgtttacttttcctccaccctatacctccttttgccttttgccatttgcagtatgaaaaatctagagaaggcttctaatgacttgaactcttttaaagaattcagaacaaaggcaccactcacccctttaggggtgtctgttttctttgtggagttccaagagttgtgggcagatttttttctcagtccaaagctctgttttcctatgttgaatgacctgatctctttggctttgagattaccacagattaccttgtactgtgagaggattttaccttggcatgtgtaatggcagacgagttacaaagtagggggtggctgagtacagtttactggaagtagtattgactgttgctatttttttcctcctaggaagttgttgtttaagaatcctaattctagtttggagatgtgttgtaaagggtctcctctattgtttttattccccaaattaatctcatttggcttgtctgtgtggatttgtgtgagaaactgaactgtggtttacataggaaaatgagagactgagttttctcagctccaaagtgaaagggcatctgctcctcccaggcaaaaggcacccctaagcaactgggggccttgtgggagtgtcttggggttgaccccctgtgacatggagtggccctgcagggaaatccccaagaaaaattaacttttaaaaaaaggctagtccaggaaacacatatgagggcagatcacccagcattttgagccctctcagaggtcatacacctctggagagagaaactgagacatgtaagagggtggaaacaactcagtggtgacacactgtggagtactgcccacaagcagcacacattgattcaccacacataaaccctaggccacagctcagttcctccttttaggaaaaaaagtgggaaacaaataatctaagaatgatgagaaaacaagaagaatgaccccctgatatcacttggtaggttttatgacacctctacttggcagagtttatgtaaaatgaaggtaatacggtctttgtgcacatatacattaagaaccctaggttgtcctgcaagctatagagttcctaagttctctctttttaaaaaaaattcttttcttcttgctttaaatttgcttttatttttctattaagataaaaaccacactatggattcaacaggtttttgtctgcaagctggtcaattttttttatctcatggctaaagttctgaagtaaaagccatagaatcttttgtgtgtgtgtacatgtgtttgcatatatttaaaaggccattataatttctataattttatgtttaataggcaattgaatccattttattttccttccagcacaccaaattttttgtctctgtaccttatgatgtaaattttgctatttaattttcacttggtttcttttaatatgcaaatgtaagactatttagcttacaactgcctatggtgatcaagtattcatacagattacctattgaaacaggttatcaagaatttggaagtctaatatggcaaaatgtagttttcataaatctataagatgtacttctattggcatgcttaatgtgtgtatgtatttatgtgttttgtacacaatgttttattactgaaaatatataaaagagctctaattaattggcttaagaaaataaaagtgcttgaattaaatactttgccagaaaaaaaagactagtcaaatgctttttcaagtttatgtaacttcaataaaatcttttataaataagataactttacaattattgctaaagtatgataatattagaaatgtcttaagaatttccagcatatatttttgtttgcatttattaatcaaacaatttcatacttattgttgccaaatactttaaggtgtcaaaatttgacataagggttacaaaactgtaaaccaagcacaaaacagaatgatctttgcttgtgtaattttttaataaataagacattgatattggtttaatgaaaatagccacatcttgaattaagtaagattatcataacttctaaccctgtggccttaagcaatctagtccacaggcagtaaggtttgttttgggaaaaaactgttatcatttttatttcaaagctaaaccataaagggtgtgaaatggcaacactatccttcaactcattttcaactcatataagtttttttcctcaagttctgtttgttgtggcataatgctaacagtgctttctaaaagctattcagctcctcaaggtccagggactatcacagaagaggtgggtgtgtgagattttaagaactgatactgagagataagttagtttatttacaaattaatcattaatgtcaaagacacactaatgcaagaccaacatatgggcccctgtgtcagattaacaaggttttctggaagcataaactgacttcttaataaagattataaaggttatgaaaggctgaggaaagttatatcttatggtcaagattagaattttatagattgttcataaaattttgaaaaacaaagttatttggcttcatgctattttattagggcttattgtttggcaaattgagtctcctctctcaaagaatgaagatttttgcctttttttgaaatccttgagttaccacattagtcaaatgaatgatttatcttacctgtgatattaagtgttttaaacctttgatatttgagaaattttccaaacaaattataaattatgattttttctgacctaagtaatcctttaatttattagtttccctaacatccaaaaatgacataatttggtttattttgtataaaaattatacaggaaacattgtcaaatatgaaatggtgtttggtctttttgagctgtatttatataagtatgttattgttatgtgttccaaaattatgggaaactcctataattctgatatgacttagtgtgtacgttatcagtaacaattatatgtgttaagttattgtgtgccacagaggtaacaaatttccttgtccattgtgtctttgactgagtctgccctaaaactttttgtcctccacagacaattgttgtcttactttggtcctctttagaaggcgattttatactcagccataaaattctaacaggtgctcttgaaaaaaagtttttgataattttggagattgtgacattagaatggaagaaaaactttcaggactcatggagaactaaaatgttcatgagtatcaagcagaacaggaattaactacatggactgaaataataaaaaactaaagtaatcttttagactttgcttaaaacattgctgatcctttgttttgtttttttttcagagtgaaggaatctttttttttttgagctattaacagcttttaacaatttagtatactcctatgaaaaaaatttagaacatatttgtttccctctacctgatttttcagaatttggaaactatttgtgagtattttttacttttgtcaatacagttatttgcataagtgcaataagaatctattttcatttttaacaaaacacaattggagaaactggttattttatcaaggcttccactggtatggtgggctttcctttagggaatcaaacttaacttatggagccaataaaaccccttgggaaaactggcctcataccttcatctataaggtccctgtacagggttcctgaactgtgttaagcaaagaatgtaactttctgacaggcccaggaaccccaagtttattttggaaccccaagaggagaggaattcacccaactcgtaggtatttgatggtagaaatctatggctttcctcagctttaaaaaagtcctatctgagattctttctataagacaaagttccatcaaagccactttaaaagcctatgtaaataaaaaattattcttcctcctctgtatacaataatcaggccaagtataataaagcaaatcagttgtaccatggtttgtctttagtaaaattgggaaactgaagacagaaaaattatgtttcaaaaataacagtatacctgttgttagattctagtcttgcctaatgtttttcaacttttattactgtctacagtttggactgaattctaatttttcatggctacacgtcttcaaaatagtgtcttcaggttttttttcctccctttccaccatttttcctagtttggagtcactgtaaactaagtcatgctttcataaagccctacaaattaagctagacaacttaaacttcagaagaaaataacagcagccaatttacatacataatccactttcttacctgcctactgatttatggacttcagagtaatgggcctatattaattttcaaggatttttcttttgtttggttttgtttttctccctttctccctttattttgtcttcataggacatgagacttcacaacctactaaaaatgaactttcctaataactcaggacctgcttaggaataaaccttccttgccattagagatcagatgaaaacctgagaccagagactcattttcttctaaaatgctttctccaaaagattttttttaaatgtaaaaggaaaataagcctgggggccccaaagtcactaagcaaatcactgcctcccattctattcaaagtcacccctctgctcactgggataaatgcatatctgattgcctccttggagaggctaatcagaaagtcaaaggaatgcctcctccctgcttcaagttggcaaaaataaactttctaaatgtactgagacctgtatcagatatttggggttcacaagattatcaatgaaatattcaaatatttaagaattgttaggcagtcttaattctagtaataaaaaagtagcaaattagtaataacctatatatttattttatatactttatactagctgtaaccttccaaatttaatataaatttattaatttttgagtgatatgagaagagtttacttatatccacttgtctactagtcataagttattttatgaatttgacatcattgattacaaaagactaaatatttaaactgcacatatggtgagaaataatgctacatatgtagtatgtgtaatttcttttcatttgctaactatcaagtgctactttcaggaaaaatttcaagtggcagtgtttgacacaaattcagactattatcagtattgctacttttgtaaatgctaacaatgtaggaaaaaggagcccattgacaattcatgattaacaatacagatgctgaaaatgtagaaaattgtattttgctgcattttgcttaactgatctttcacacttagatgatgcactacctagcattgacagccttgatatatggtcagctatagccagtcattaccatgtctagtaccaaactaaggtactgattttagaattcccaagcaatctttataaactggagtagaatttacaagtgttgaccttgtatttgatatgggagtgttaaagtaactctgtgttttcagcaaaaacttgcatagatcattcagagagggctatgtcagataagaaactaaaacgtaaattgaaaatacacaaagattgtatagattagaaaataagttcctaccatgtttatttatattttctgctccttcctcaatctggagaaggcactaatctgattcttagagcatagtctttgttgggccacatttaataatgcacatagtctaccctaaaagcaggattctatctccatcctttccattacatttttctgcttaagacattagtggcacccaagtcagcagagcagacaagttttttttttttttctctaaatctacttggctaggtgggtacctccagagcagtggctagtcagactaggacattctttctctgaatggcaccctgaacagaacgctaaatagacctattccaatgcatgggaagtaaaaacagccagattgcttggtaagacgaagctgcatgatgcatttcaaagttttttcaatacctgcttattgttattgtgatagtacagtaacttattaaaatttaactgctttttgataatatctacagtgtatacagtaccttctaaaatcctgtaaaccaaaaggagcaaatgacagggcagaatttagtgatttctatgtacatgctacgataccatgataataccaaacttcactagcacctcttaaatatatttccttctgatcacaatattaatgccaacgttattatcaaccaaaactcctctctttatgattttaagatcttccatatatgtttttgctttgaacagatgtctgagataattagaactatcatagcagttaaattttcaggcagaacatttctgtaatggactcttgaagagtttaacagattcatttagtagccatccacagttaaggcactttatctaaccttttgtgggatctgggcaagggctgatgcaatcatgttggcactttcttctgacatgttactgatcatcgaccccagagaaaacaccacaataccattttctccagagctctgcacaaactcttccatttcctgtgaagaaagaatttgttctatcagaaaagagcaacagcacagaaaacactattgacaggattgttacaaacatctaagatgagaaagtcaggagctattggagtaatttttttaaactgacctaatcattcagtttctttgaaaggagatgtgtaatataatatatgtgggatctttcatgcaaatttgtgtaaatatgtgtgcatatgcatgtatgtatgtgtgtgtaaggaggaaatgaaacaaagctatgacactgcagtaggaggagataatgctagaaaatgttacacccagacactttatttataatattataattactaacataggttattggaaggtagctttacttggcttcaattctaattttttttgtggttctactaaatctcttgtgtttatttggagtagttttattttattttatttttttctgttcagttcttttagttaggagtcattggagccattacatgactatgagcaatgaggaaaagttagttacaattggaatgatattatatctacatttatttagcttctagctctctaaccctttatatttcacttaaagttagggtttcctagtcttaccccactacccctcactgcccccgacacccccaccccccaaaaacaccttaaaagctgaagtataagaatcactgacattcagcagtctggtattgtggtttggaatttctgggaaatagttctgagaattccatttataatacagtattatatactatatagttacataattaagtgatcttatttctcaggtcattgcttaggtatgactatgacaccttttgtcctgaaatcacactgtgaatttgatgtgctatgtataactgaatgtgggggaccctcatcatcactttgctgtgtctcacagggggcacttgaaccacagtgggagaggtcaccaggactttctccagtggagatctgctcaccccctagagtagctccctcacactatatgaagctcctggtgaatatgtgtttgctttgaaatgaatgagaattattctgacttgtgtttcctgatgtgtccctgtttttaaacttaaatccattctctaatgccacatcgctcaatgtattctcacaccaaaaaaaaaaaaaagagagagagaaagaggaaaagaaatgtagacccataagtttcctggatatcatatcaaaattgtatactcatctttttgttgctgttgtcccttttgttctaaattctctttttctcagtaaaataatgaccaaccccttctgtcataacaaatatactttctggtcctaatcattgggggaaatttctttataaaactgtttacaaataaaaaaagaaattctaaaatatgtcaattcagaccatatattggtaagtatttttaaaaaatataatttaactttatgacatcttttttttttttccagatggagtctttctctgtcacccaggctggagtgcaatgatgcaatcttggctcattgcaacctctgcctcccaggttcaagcaattctcctgcctcagtctcctgagtagctgggattacaggcacctgccaccacgcctggctaatttttctgtttttagtagagacaggtttcaccatcttggccagagtggtcttgacctcctgaccttgtgatccacccgcctcagcctcccgatgtgctgggattacaggcatgagccactgtgcctggcctgacatcagttttaattggagattcagtgtatggctattagagataattcatgaggcatccaggaactcagtgtaattgcagttgcctgtagccacatttaatgtaacttgagttcaatgttttgtctcattcactgccaaaagtctgcttcacccacccagtattgaagtaataaaacatctatttatagacagatcagcactgatctcattctgtgatgtctttatgaaagtaatggtaatagaagatcaatgtaagtagttttataaaagtatgaaaatttagaaaaagaaaatcatttacccatatctctatctcaatttaaaatgtgtaccatttcattatgggtttaattctatttatataactcaatgtacatatgtgatgtttatttagaaaattttattctcattgtatatgcctttttattctacaaaaaaactgtgatcttgttctactcatcattttgttccttagtttccaactatacctgtaccacggctgacagtgtaattaaacattgttttgaaaaaaggattgtaatggcttggtatgcacattatgtaagtttttaaccatttcttaatgtaagatatttgaattatttccagagtttttttaatgagtatttgctaccgatattgaatcttaccatcatgatttattctctgtacagtttcatgtgagtatattataaaggcaatgcctatatgcatttttcaaacacttgatactttttggcaagagtcttattcttttgaaatatacaaacattatctgagaatctaatacataatggaaaagcaagcaaatttgtggcaacaattattttgtgtacaaaagaattagagaatcagtttcacaattatttacttggattcaagtctaccttctgcaagttaacaacaacggaggctcacacttgtaatcccagcactttgggaggctgaggcatgtggatcacctgaggtcaggagttcaagaccagcctggccaacatggtgaaactctgtctctactaaaaacacaaagattagtcagatgtgttggcaggtgcctgtaatcccagctactcgggaggctgaggcaggagaatcagatcgcttgaacctggggggtggaggtttcagtgagccgagatcatgctagtatcagtaataatcactattgtactactagtcatttatcccttgtccttattctgctactctcttccccctgctactggcactatcactttcttttaatgtgagtgaggaatttttttttgagaataagataagagtacacagaattaccttttaagctagaatattaatgaagagcctccacctttacaatacaactttagctttccagcttgttcaactgactgcccaaacttaaacatttacatttaaacaagtacacagagtatctgttctctaggactttgctagagaatataatcttgatgtgttggaaaatcaatcactattaaatgaagactgatatcttaaatggctggcacatgttagctaatttaaagtattaaaaataatgactaaaataatcataatatcaacaatatttttggatcactggctgtgtgtcagagacaacttaagtgttttatctgtggtaactactttttttccacacagcacaatatgaagttgtgattattattataaaagtagtcatgattgcttaaactcatgtaaaagttcctaaatgatctttacattttacaaacttgcctttttgcaatattatacattgggaatattgggattttttaaaaggaaatctgatcatatctcttcatttcttaactcttttcactcttttcagtagctctccattgtccctatgggtatatcaaattacatatatatatatatatattttttttttttttgagacagattctcactctgttgcccaggctggagtgcaatagcgtgatctcggctctctgcaacctctgcctccggggttcaagtgattctcctgcctcagcttcccaagtagctgctattacagtcacctgccaacatgcctggctaacttttgcatttttagtagagacggggtttcaccatgctggccactctggtctccaactcctgacctcaggtgatccacctgccttggcctcccaaagtgctgggattacaggtgtaagccaccacgcccggcccatcattgacttttactcaaccttttcctgtaaattaaatttggagttcctgggaactgcccttattgcttttctacttttctgccttaatgcaagcctttactttttttttttttgtttatttgtttgtttttgagacagagtctcgctctgtcgcacaggctagagttcagtggtgtggtctcagctcactgcagcctctgctcccagactcaagcaagcctcctgcctcagcctcttaagtagctacgactatgagactacaggcacacaccagcatgcctggctattattttattttttatttttgttagagatgaggttttaccacgtttcccaggctggtctcaaactcctgagcccaagcaatcatgccttctctgcctcccaaagtgcagggattataggtgtgagccaccttgcctggcctctggttttctttttgggtgtttctcatcccctcatcgtttcacctatctctgcacattattgagtactcactttaattgtcaatgagtttgggatctcttctgcatatttctttatcattgtggtctttccttataacactttttagacttttctttttcattgtttttattctatctttcaaagtacaatgtaaggcatgagggagcagaaactgtgctacctttattctctgaaaatccagcacttacctgtggtttgtattaatcactctacaaatattttttgaagaaatgaatcatactatcttttgggtggcacaatgaaggccttactttaaccaaccctgttttcaaaatctccctagtaaacctctttggtctttaatgataataacattcacatacttgtgatactacagaaatatatgattttctaatggcaagtccttgtttttgacctcccatattcccctcactctgagttaaacactctgaaagaaacatatccagccattccttctgaaaatgtcaagcaaacaaatgaaacaagaacacatttaccttaggcaggggtttggctggtttacagtgaagtcctccaacaaaatcaacatttggtaagaatgggcgaggaaattcaaaatcccaataggttcgaatgagccacatttcagctttccccattgtctcaaataatgtagtgggtcttcctgatggaaaaaaacaaaacaaaacaaaaggtagctaacacgagaattgttatttgaatatgcaggtattttcctgaaaggacttggaataacatacccaaacatatataaaatgtctgtgcattgataaaatatatataaatacatttatatatagtcataatttagattttatttattgcatatgttgctcatatgtatatataaggaaggcaatgtattcagagatctgtaagaagaaatcacatctttaatgtaacatcagtatattcacaatcataaataattattaaaataagtcactaatatggtttgactgtccccacccaaatctcctctcatcttgaattataatccccataatccccatgtgtccagggagggacccagtggcaggtgattggatcatggtgtggattcctccatgctgttctcatgatattgagtgagctctcatgagatctgatagttttataagtgtctggtatttcccctgcttgcacttctctctcctgccactaagtgagaagatccaagcttgcttccccttagcctttcaccatgattctaagtttcttgaggcatcccagtcatgtagaactgagtctattaaacttcttttctttataaattacccagtctcaggtatttctttacagcagtgtgagaatggactaatgtagccactatgaacttaaatacacatttgtcttccctctgaagctgcaatagtaacaaatatacctttaaacaactctttcagttccacaattaattcatcttaccttacccatgaaaacagctttccaggaagtactctagtgtctacagtttattaagctagtcccttgatccttggttctcaaagtaaaccatgagttttttgagctcaacactgaaatctttacacctactactgtcttggttcatcttaagatcttaatataattagatttttaaaataaatatatttacaaatgagaattaaaacattttcagaatttattgacatagagatatgtgctctcccttaatttggcccctattttctttgatggagagatgcagtttaataaaatatagattaaaacttagatgttcactttcaacaagatttcagtttttgaaagaaataattgtcaacctgttattgaaggaatgtataaacattagaaatctcaagttttaggcttctgtttctggagtagagccactatattactcaactgtgaaggaatccttcttacatgaaaaacaaaatttaatttctaaatgaggaaactgaggaactcaaagagaaacaaattcctcaatcctgcattgataatttttctagaaatatgtgtaaatactaaatttacgtgtctgccttcatgaagatgtttcttgaggtatctattgactttttttaaagatgaaaaaatgtatagcaaaatgatatgtgatagtttaaagaaatcattagtgctttacaatgaaggtttatgactctctgggtgtcctgtagtagtgatggccccagggttctaactgattctataaggtcaacattctataatatttttgagactgatagatcatcttacatttgcaattcataatttcccttaaaaacactatcttctgacattatatttatataagctcaccttcaaaggcacagaaaagttagaacttaataagcaccagttagacacatgacttacctagaacttcactataaaactggtcccacttcttcagatcataaatttgaaaccaaaagtcaaaataaagcatatgtatcatattttttatcctctccatgaaaatcatttgatcacttaattctgacataacaacaggtacataggaaggagggaacagaaatcctccaccattcttctcaaatgtgtagccaacagagaatcgaagactgtacagaaagggtatgttaaatagttcagccagtagctcaccacagggattaagggcatctgccagaatgacatcaaactttgactcttgtagtttcatcataagtttcttattcaaaactgcatctttacagagcttgttactgtagtcataatattcccaacacaattcttgtaattgtgaaaaatatgaccaaaatgtattttttgaaacaccatatatccatctatcgagaattttcagaagagaatcttccaaatcatttttagttaaagatgtaggataaacttctaatttaatagcagatgatttactggcattgacaagagtagaagccgaagatgtcaacacagtcacctcatgacccctctgaacaagctcttccaggattgtcttcatatttatccaatggctgtattctgtgggccacactagcacctttccacagcttccagagctaaagtaacaactgagctgtatcagcagaaagactgacgtccatttcagagacatcctggtcttatgcaatgcttcttttccagttgttgtttctttctgtcatttctcatacttatatctgaggaaaaatcaatcaagttaaaatataactgctaaaatttgaagtaaatacataatactaacagtctgaataggtgcatgccaaggagaccaacaaaagattgatgacctcatatttattttagtgtgtttggtgttcttttatgtttacaattactctagtcaagcaataatttttatgacctagaatatgtaagtaacctgtcttatgtaattattttataatactgttaagaacagtggcaagtgagaggctcctgcctgttcggtgcccttgacatagagagaagaagtaattatacaactcaaacggcattttttaatatcgtggtgcaagtaatgtcttctaaaactttgttgacacataattcatatgccatatgactcaccaattagtgtgtacagttcaatgtttcctagtatattcacagaattttactttcactacaataatcagtattatctccaaaagattctatacaatagcctctaaccccccactctgaaattttgcatccatcctaccctaggcaaccactaatctaatttctatctctatagattagcattttctggaccctttaaaaaataaatgagggttttccagtgatcatggcagatgggatgcaggactagattgcagctccagacagagcagcatgcagaggcttgcattgtgaattttagctgcagatcaactgcaagaacagaccagcaattctgagaggatccacacaccctctgcaggaagcgtactgctcctgcaggacctgggagacatcccaaacactgtgagtgccccaacaatggaagtgggaaagggtgatccccctctccagaatacacatccccactggagaagctgaagttctgttggcaggagaagttcctgactttatgtgaagctgagtcaaattagagaaccaagccaagcaaaatacaggggtagaggaagtagcagaaaggcactgggagctctctggatacccaagcggctcattcctgcctggcatcacagggatctatcaggagggtggccagtgatgcagggggttcaaagattctcctcagggcctgaaggcttgaagggatgagtaactcctcccttctcaggcccagccccaagatgcaagaccacttgcatcagcagcgtgtgtcagcaagatagcagaagcaggaagagagccggccagaagacacttaccctggctggaagagatgtacccctgaagatcaagaaataggccatccaggtactacatagcagtcacaacagactgggacacttactgtttacagaggactacaaaacccctgtcccatcctcactgggggctgatgccattttaggcctcagcccacctgcaaccaggcgttcattaaaacagcatgttgctccacaccgcctcctgttgtctgttggcgcgctgttggggttcaaactgattcaagaaccttacatctggtgccaaatcctaggaggggctcaggtctgtgtcgcttgtggacctacccctccaccccagagagcaggccacagcaattagacagaggaagctcctcagcctccagtcgcctctctgtgcatgcgcatcagccactgatctcgcctactggtaagtttcccttggagcccggttaacagggcaaaatctacatggcctctcttggtttctccagtccaaaaatccaacactgatccaagaaggcgccagcgtgcgccaggcactcgctggtcatctggtcttagggggatgcctctaagccatttcatcccattccaggaaccaaaaaggcagcggagacgataactccttttatcgtctccctccagctgtccaggatggtctcctttttccctgttctctcgagctacccttcattatgggaaactcccggtcctcaattccaaaaaacagccctccagcctgcctcattaaaaatctgcaaaccttaggcctcaggcaagatatctgccataagtgccttgtcttttttatacgataaagcctggtcgcagtatgaattagataacgggtccaaatggcccgcaaatggaacactcagctttacagttttaactgacttaagcagttattgcagatgactgggaaaatggggagaaattccttgtgtccaggcctttttgcactcagatcacagcccgacctctgcaattcttgcttacctgttcaaatccttcttcattctcgccgccctcattgcctttatcctcccgaccctacctctttttcctcattggatggagcagactgctgtccacccctcccagaccctacccctccatctcaaccaacttcattaactccccaagcttcctcattgtcttctcagccaccatcttcccagccaccatcttcccagccagcatcacccacttcttttcctataccatcctctcctcaggaaaactctagcattgcctgtactcattctccttccttacagccctctcacggagcctgtaaacccatcccgccaccttacacccgtatctatcctccaatgcctatcaactcaaccccccttccctcttcaaaccctcagcaggaaccccttctggcttcttccttctctcctgcccatactagctccggcaccatctttggcccccatgccccacccgtactttagcgccagtgctagaatgcccccttcgggaagtagcaggaactgaaggtattgttagagttcatgttcccttctccctcactgatctctctcaaactaacaaaagactcagttcatttccagaagatcctacctcttatattagggagattcagtaccttactcagtcttatgaactaacctggcatgacagctacttatcttctcttccaccctcaccccagaagaccagcaccgtacttggaccctagctcaggtgcatgctaatacaattcatcatcaagctcctgcccagcctactggcacagaggcagttcccaaccaggacccccactgggattatcaagacagggcctctggacacagccatcaagacctcatgattatgtgtctccttgcaggactcaaaaagggtgcccataaagtggtaaactatgaaaaactttcagaaatcaccgaaggtcctgacaaaaacccagccctttttctctcttgtttaactgaagccatgagaaaattaccaacctggacccagccagcccagaaggaaccactatttcaaaccttcagttcctcacccaatctaccatgatatttggcgcaagcttcagaaggttgatgacggccctcaaaccccacagtgggaccttcttaatttagccttcaaagtctttaacagttgtgatgaggaaagtaaaagaaaaaaacagtttccaatgcttgcctttaccctgcaggcccacagggccacagctccatacagaagcctcctagcaaaacacctccacctggcgcctgtttcaagtgtggcaatgaaggctactggtccaggccatgcccaaacccagctgtgctcaccaggctgtgccccctctgtggaggactcagtgaaagtcaggctgtgagcggctccagcaaggatcgcctccatccctttccgagctggccaaaacctcctactcggatctcatcggccttgccactgaagactgacagtgccctggaacagatgtcccagcaactaccattgcttcatctgagccaagggtaactctgatggtggcaggtaggcatgcatgttttttaaaaattaatattggagcaacctactctgctttacctaaattttcaggacccacccagtcctcccaagtctctgttgtgggaatcaatggacaagtctccaaaccccaagacccccctccacttttctgctccctgaacaccttttccttcagtcactctttcttagtcctgccttcatgcccagctccgctcctaggcagagatattctttcaaaactccacactactctccacttccacattccccatagtacccaacacatcaacccagacccctccaaggcttctaacaggcttctaaccttcttctactcctccgacctcccaccctgaaacatgcaacttttccttatcccgcacctgtagttaaccccactgtttgggatacttccacaccctcggtcacagagcaccacacccccatccacatcacccttaaagagcccaccccgttcctatcacagaagcagtatctcatcccccaagcagctctcataggcctaaagcctatcatttctctcctcctcaccagtcacctactctgcccaacaaactctccttttaacacatcagttctacctgttaaaaagccagatggaacttatcacttagtccaggacctcaggctcattaaccaagctgtactcccagtgtgtccagtagtttctaacccatatactttactttcctcacttccctcgaataccacccatttttctgttctaaacctaaatgatgctttttcacaattcctttacaccctgattcccaaaacctctttgcctttacctgggaaaaccccgacacccacctttcaggtcagctcacctggtgcgtactacctcaaggttttagagacagcccccacctttttggacaggcccttgctagtaacttctgtactttatccctaaaatcatcctctcttctttaatatgttaataatctgctcctgtgtagcccgtctcaaagagactgcaacacccatacatactatctcccttttaaacctcttggcagaacaggggtatcaggtctcccctaagaaagcccaaatatgcaccccccagtcacctatctaggcctagctcttacccctgaatgcaagggctcacaacagaccacatactccctccttctgtccctcccgcctccacaaactaagcaagaaattctctcttttccaggattagcaggatattttaagctctgggtttcctccttcgctctacttaccaaaccgttgtaccaagctgctaaaggccctctccatgagcctttaaaacctgcacagcctattacccaacctttccatctactccaaaagtctctcatctcagcccccatcctcactctcccagacttcaccaaacctttctccctctataccgatgaatggcgtggagttgcactaggtgttctaacccagtctaagggacccacccggccaggttgttgcctacctccctaaacagcttgaagccacagttctcggatggcctgcctgcccctgagcattggtggcagttgctgtcctcactcttaaaagcctaaaactatctcttcatgccaacctaacagtttattcaacccataacatcaaagacatgttagctcaccgcagtgtactaagtcttttctctgccccacggctcctccagctgtatgctctattcatagaaactccccacatcaccatgctaaccacctcccatctaaacccggccatgctcttacccgaagctacaaccgcccaagactcttcttcacactcttatgtgtgaatactgttcaaacctttcttataccttttccaaacctaacagaaaaatcccttccagatgcgtcctttactcggtttgtagatggcagctccttcctacatcaaggacaccgacatgctggctatgctatagtgtcaccccccaacactattgaagtcaatctgctcctcttaggcaccacctcccaaaaggctgaactcattgccctcactcgagctctcattctagcatccggaaaacagatcaatatattcaaattctccttatgtgttccacgtagtgcactcacactcatccatctggaaagaacggggtttcctcactgcaaacaatactgtcataagtggctctctcatcagcaagctccttcaagctgccaggctcccacagaaagttgccatcattcattgcaggggccaccaaaccccagacaatcctaaattggctggaaatgtgctagcagatcaggtagccaaacaagtagccctactaccctttcgaggccagttgctgtccttgtccttgttctctcctctttacttctaagaagaaaaagatttccaagcccaaaaccttcaaaagcaaggacgatattatgtcaaggaagggtgcttagttattcctcactctcaaagccttcctcacctccaaagcctccacaactctttccatgttggttaacaacctcttgcagcttctccacgctattctcacttgtcgtcacttttccagccatgttcaagaaattatccagtcctgctctatctgccactcaatgtaaccccagggatccctccagcctctgccttttcatacccaccaagcccagggccaggtacctggggaagattggcaagtagacttcactcatatgctgcatgataaatgtctctgctatcttctaatccttgtctgtactttctctggctagggagaagtgttcccaacaacttcaaaaggtgcaaatatcatcacacaaactcatcatgcatacagttccctgtttcagactcccaacatccatccagtccgataacagtcctgccttcatcagccacattacccgaggcatctctacatccttaagaataagtaagttctccacacaccctacacacctcaatcttcaggcaaagttgaaaaaattaactctgtccttaaagcctaactcatcaagccggctctagaaacctgcgagtcatggacaaaaaaatctcccttttgccctcatgagactttgcacaacaccaaaagcaccctctttttttgtttttgtttttgtttttgttttgttttgttttgtttttattatactttaagttttagggtacatgtgcacaacgtgcaggttagttacatatgcatacatgtgccatgttggtgtgctgcacccattaactcgtcatttaacattaggtatatctcctaatgctattcctcccccctccccccaccccataacagtccccagtgtgtgatgttctccttcctgtgtccatgtgttctcattgttcaattcccacctatgagtgagaacatgtggtgtttggttttttgtccttgtaatactttgctgagaatgatggtttccagcttcatccatgtccctacaaaggacatgaactcatcattttttatggctgcatagtattccatggtgtatatgtgccacattttcttaatccagtctatcattgttggatatttgggttggttccaagtctttgctattgtgaatagtgcagcaataaacatacgtgtgcatgtgtctttatagcagcatgatttatagtcctttgggtatatacccagtaatgggatggctgggtcaagtggtatttctagttctagatccctgaggaatcgccacactgacttccacaatggttgaactagtttacagtcccaccaacagtgtaaaagtgttcctatttctccacatcctccctggcacctgttgtttcctgacttttaatgattgccattctaactggtgtgagatggtatctcattgtggttttgatttgcaattctctgatggccagtgatgatgagcattttttcatgtgtctgttggctgcataaatgtcttcttttgagaagtgtctgttcatatcctttgcccagtttttgatgcggttgtttgtttttttcttgtaaatttgtttgagttcattgtagattctggatattagccctttgtcagatgagtagattgcaaaaatgttctcccattctgtaggttgcctgttcactctgatggtagtttctgttgctgttcagaagctctttagtttaataagatcccatttgccaattttggcttttgttgccgttgcttttggtgttttagacgtgaagtccttgcccatgcctaatgtcctcaaagtattgcctaggttttcttctagggtttctatggttttaggtcaaacatgtaagtctttaatccatcttgaattaatttttgtataaggtgtaaggaagggatccattttcagctttctacatatggctagccagttttcccagcaccatttattaattagggaatcgtttccccatttgtggtttttgttaagtatgtcaaagttcagatggttgtagatatgtggcattatttctgagggctctgttctgttcccttggtctatatctctgttttggtaccagtaccatgctgttttggttactgtagccttgtagtatagtttgaagtcaagtagtgtgatgcctccagctttgttcttttggcttaggattgacttggcaatgtgggctcttttttggttctatatgaactttaaagtagttttttccaattctgtgaagaaagtcattggtagcttgatggggatggcattgaatctataaattaccttgggcagtatggccattttcatgatattgattcttccttcccatgtgcatggaatgttcttctatttgtttgtatcctcttttatttcattgagcagtggtttgttgttctccttgaaaaggtccttcacatcccttgtaatttggattcctagatattttattctctttgaagcaattgtgaatgggagttcattcatgatttggctctatttttgtctgttattggtgtataagaatgcttgtgatttttacacattgattttgtatcctcagactttggtgaagttgcctatcagcttaaggagattttgggctgagatgatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctttcttgtgccaattttcaaagggaattcttccagtttttgcccattcagtatgatattggctctgggttgctcatagatagctcttagtattttgagatacatcccatcaatacctaattcattgagagtttttagcaagaagcgtcgttgaattttgtcaaaggccttttctgcatctattgagataatcatgtggtttttgtcgttggttctgtttacatgctggattaagtttattgatttgcatatgtagaaccagctttgcatcccagggatgaagcccacttgatcatggtggataagctttttgatgtgctgctggattcagtttgccagtattttactgaggatttttccattgatgttcatcagggatattggtctaaattctctttttttttgctgtatctctgcgaggcttcagtattgggatgatgctggcctcataaaatgagctagggaggatttcctctttttctattgattggaatagtttcagaaagaacggtaccagctcctccttgtgcctctggtagaattcggctgtgaatccatctggtcctggactttttttggttggtaagctattaattattgcctcaatttcagagcctgttatcagtctattcagagattcaacttcttcctggtttagtcttgtgagggtgtatgtgttgaggaatttatccatttcttccagattttctagtttatttgcatagaggtgtttacagtattatgtgatggtagtttgtatttctctgggattggtggtgatatccccttaatcattttttattgcatctatttgattcttctctcttttcttctttattagtcttgctaacgatgtattaattttgttgatcctttcaaaaaaccagttcctggatttattgattttttgaaaggtttttgtgtctctatttccttcagttctactctgatcttagttatttcttgctgtctgctagcttttgaatgtgtttgctcttgcttctctagctcttttaattgtaatgttagggtgtcaattttagatctttcctgcttcctcttgtggggatgtagtgctataaatttccctcgacacactgctttgaatgtgtcccagagattctggtatgttgtgtctttgttctcgttggtttcaaagaacatctttatttctgccttcatttcgttatgtacccagtagtcattcaggagcaggttgttcagtttacatgtagttgagtggttttgagtgagtttcttaatcctgagttctagtttgattgcactgtggtctgagagacagtttgttataatttctgttcttttacatttgctgaggagagctttacttccaactatgtagtcaattttggaataggtgtggtgtggcgctgaaaagaatgtatattctgttgatttggggtggagagttctgtaaatgtctatcaggtcaccttggtgcagagctgagttcagttcctggatatccttgttaactttctgccttattgatctgtctaatgttgacagtcaggtgttaaagtctcctattattattgtgtgggagtctaagtctctttgtaggtctctaaggacttgctttatgaatctgggtgcccttgtattgggtgcatatatatttaggatagttagctcttcttgttgaattgatccctttaccattatgtaatggccttctttgtctcttttgatctttgttgttttaaagtctgttttatcagacactaggattccaacccctgcctttttttgttttccatttgctcggtagatcttcctccatccctttattttgagcctatgtgtgtctctgcacgtcagatgggtttcctgaaaacagcacactgatgggtcttgactctttatccaatttgccagtctgtggagtatttagcccatttacatttatttttaaatgtattggagtatttagcccatttacatttaaggttaatattgttatgtgtgaatttgatcctgtcattatgatgttagctggttattttgctcattagttgatgcagtttcttcctagccatgacggtctttacaatttggcatcttttgcagtggctgctactagttgttcctttccatgtttagtgcttccttcaggagctcttttagggcaggcctggtggtgacaaaatctctcagtatttgcttgtctgtaaaggattttatttctccttcacttatgaagcttagtttggcgggatatgaaattctggattgaaaattcttttctttaagaatgttgaatactggcccccactctcttctggcttgtagagtttctgtggagagatctgctgttagtctgatgggcttccctttgtgggtaacccgacctttctctctggctgcccttaacattttttccttcatttcaactttggtgaatctgacaattatgtgtcttggagttgctcttttcgatgagtatctttgtgttgttctctgtatttcccgaatttgaatattggcctgcattgctagattggggaagttctcctggataatatcctgcagagtgttttccaagttacttccattctccccgtcactttcaggttcaccaatcagatgtagatttggtcttttcacagagtcccatatttcttggaggctttgttcatttctttttattattttttctctaaacttctcttctcatttcatttcattcatttgatcttccatcactgataccctttcttccagttgattgaattggctactgatgcttgtgtattcatcaagtagtctcatcctgtggttttcagctccatcaagtcctttaaggacttctctgcactggttgctctagttagccatttgtctaattttttttcaaggtttttaacttctttgccatgggtttgaatttcctcctttagcttggagtagtttgatcatctgaagccttcttctctcaactcatcaaagtcattctccatccagctttgttccatttctggtgaggagctgcattcctttggaggaggagaggtgctctgatttttagaatttccagtttttctactctttttttttccctatctttgtggttttatctacctttggtctttgatgatggtgatgtacagatggggttttggtgtggatgtcctttctgtttgttggttttccttctaacagttaggaccctcagctgcaggtatgttggagtttgctggaggtccgctccagaccctgtttgccttggtatcagcagtggatgctgcagaacagcggatattggtgaacagcaaatgttgctgtctgattgttcctctggaagttttgtctcagaggagtacccggccatgtgaggtgtcagtctgcccctacaggagagtgcctcccatttaggctactcagttgtcagagacccactggaggaggcagtctgtcctttctcagatctgcagctgcatgctgggagaaccaatactctcttcaaggccatcagacagggacacttaagtttgcagaggtttctgcttccttttatttggctatgctttgttcccagaggtggagtctacagaagcaagcaggcatccttgagctgcagttggctccacccagttcgagcttcccagctgctttgtttacctactcaagcctcagcaatgtcgggcacccctcccccagcctcgctgccaccttgcagtttgatctcagactgctgtgctaggtatgagtggggctctgtgggcataggaccctctgagccaggcatgggatataatctcctggtgtgccgttcactaagactgttggaaaagcgcagtattatataaagagtgacctgattttccaggtgccatctgtcaccgctttctttgattagaaaagggaattccctgaccccttgcacttcctgggtgaggcaatgcctcaccctgctttggctcatgctcggtgcactgtacccactgtcctgcacccactgtctgacactccccagtgagatgaacctggtacctcagttggaaatgcagaaatcacccatcttctgtatcactcatgctgagagctgtagactggagctgttcctatttggcctagctaattattaatatttcttttcttatagtaattttggttttggtttgttcttgcttttctagtcatttgagatagatcattacattttttatatgaaacctttctccttttcttgtgtaggcatttcttgttctaaacttgtctcttaatagtgcttctgttgaatctcacagattttgctattgcatgatgtgatctttctttgttttaagcaatttcaaaattgtttcttttttatctattggttataaggaatatgttgttaaattttcatggatttttctagttttgtcttggcattgattttataatttatttcattgtgttcagataaaataatcagtaaaatttttattttttaaaatttgttgagacttgcttaatgtcctcatatatggttaattctggggatgttatatgtgctataaaaagaatcttacattctgcagctgttggttaaaatgttctgtaaatatcaactacttcaatttggtctatggtacagtttaaatctcatgttgatttattgtctaaatatctgtccaatgctgaaaaggtgatggtgacatcctcaactattattggacttaggtctatctctcctttcaggtataataatatttgcttcatatatctcagcggttcatggttggttgcatatatatttacatttttgtctttttgaacaattgattcatttattatcatattaagtctctcttttcctctcaaaattttggcttaaagtttgtgttttgctgaggtaagtgtagctatttctgcttgatttgggtttctgtttgcatagcatatctatttcatcttttcaattgcagtctatgtgtaactttattggtgagatgagtatcttttaggctgaatattgttgagtcttgttttttaatccatcaatctacgttttcagttgtgtaatttaatccacttattttcaaggtatttatttatttataggtaaaggcttattcttttatttttttctgtttattttgtatctcccttattccttaatttctctcttattacttattttgacagtttgatagttttctatactgataaagtttgattattttttctttcacctttgtctgttggctctatgagtgagttatataattttgtgtgtttttatgaagtgtattatcatcttttcaccttcagatgttagacttcctcaaatattccttttaaggctggtttaatggtaataaattctttatgtttttgcttgtttgagaaatactttattcctctgtctctgttttttttgtaggatcaaagtttgctttatataatattcttcattgacatgattataaaacaaattttatcacttagcatatattttcctattctttcctggcctataagttaatgctgagaaatccactattagctgaatgaagattcccttatagatgatgtgtcagctttcttctgccatttttagaacacctgctttgcatttgacttgataatttgacgatatgtgcatcagtgaagacctttttggattgaagtaacttggtggaactttcagcttcttggatctagatgttcatcttttgtcaataacttaagaagctttctgctattatttcattgaatataatttctatgctgtttatcttctcattctagaattttcatcatgttaattttttttcttttttacttagtgatgttgcataaattctgtaggattactttattctttttcttctttcttgtctatgtgagtcatttcaaaaacatggtaatagttggaaattatttcctctgctttgtctcttatgttcttgaagctctcaatagtatatttttaaaaaaatttgttcattgctttaaagtattttatatttttgtgggtacatagttggtggatatgcttacggggtacatgagatattttgatccaagcatgttctagtgaaaaatttttacaatgaacaattcaataaagttgcagaacatgaaattaacaagacaaaatcaataacatttctatttgcctacaatgagcagctgaaaaagaaatcaaaaaagtattcccatttacaatagtcacaaataaaattgaacatctaggaattaaaggactgaaagatctctataatgaaaactactgatgtaagaaattaacactgatgtaagaaaacactgatgtaagaaattagagggtaccaagaaatgaaaaaatattccatgttcattgattagatgaataaatattgttaacatttctatattaagcaaaacaatctactgatgcaataaaatcatgaaaataccaattacattcttcacagaaatagaaaaaaatctcaaaatgtatatgaaaccagaaaagacccagaatagtcaaaggtatcctaagcaaaagaaaccaacttggagtcacattatctgacttcatattacactacgcacctatagtaaccaaaccagcatgttactgccataaaaacagacacagagatcaatgaaacagaatagagaacccagaaaacaatctacacacctgcagtgaactcattttcatcaaagttgccattaacatacacagaaaaaaagacagtctctttaataaatggtgctgggaaaacagaatatctatatgcagaagaatgaaactagatccctagctctatccatatacaaaaatcaaataaaaatggtttaaaggcttatatctcagacctcaaattatgaactactacaagaaaacattaaagaaaatctccaggatgtttttctgggccaaaatttcttgggttataccccataatcacaggcaaagtaaaaatgaacaaatgagatcacatcaagttaatcagcttctatacagcaaaggaaacaatcaacaagtgaagagacagtccacagaatgggaaaaatatttacaaactatccatctgacaaggaattaataaccagaatatataaggggctcaaaccctctataggaaaagataaaaaaatggacaaagaatttgaatagagatgtttctcaaaagtaaacagaaaagtggcaaacagacatgtgaaaagatgctcaatatcactgatcatcagagaaagtcaaatcacaactacaatgagacatcttctcacaccatttaaagtagcttatacccaaaagacagacaaaaataaatgctgatggggatgtgaagaaaaaggaaccctatacaattttggtgggagtgaaaattagtaaagaccactatggagaacagttgacggttcctcaaaaaaatgaaaaatagagctaccatatgatccagcaatctcattgctagatatatacccaaaagaaataaatcagtatgtcaaagagatacccgcactcccatgtttgttgcactatttacaatagctaagatttagaattagcgtgaatgtccatcaacaaatgaatgaagaacatgtgttgcatagacacagtggagtaccattcagccatgaaaaagaatgagatccattcattttcaacaacatggatggaactggagctcattgtgctaagtgaaataagccaggcacagaaagacaaacatggtatgttatcacttatttgtgggatctaaaacttaattaaactaatgaacatagaaagtagaaggctgattacttgagcctgggaagggtactgggggcatgggggtaagcagggattttaacaggtatgtaaaaaggaataagacatactatttgatcacacaacagggtgactatagtcaataataacttcactgtacatttttaaataactaaaatagtgtaattatattgtgcataagacaaagtaaaaatgcttgaggggatagatactccattctccataatatgcttatttccaattgcatccctgtatcaaagtatctcatgtaccccacaaatatatacatttactaggtaaccacaaaaatttttaaaaattgaaaatttaaaaatttgaaagatatacttaatggaaaaacaagcaatttgtaatacaattattttatgtaataaacaattaggggacaggtttcaaaactattgacttggatttagtaacaacagtaagtattagcaattatcatgattgtactattagtcattctttcacttgtcctacttctctaccaactcttccgtttcctggtggcactattaatttcccttaatgtacatgggaaaattattaaaatataaagttagattgctttgaatttttattagtatttcatcaacttttatctcacgagaaagttaccatgtagaccttatataatttgcattcaacatggatattatgttttagccattgaataagattttagttgtatgttgatgctaataagaaggtaaacagaaatgatcccctaagagactgtataataatgttgcaaagaataattgctatctatatatatcttaaaagtgtgatattaatttaaaacacatgagattcttgtgttctctcataaggaatattctatagaataaataattgttattatgaactaagggcacttttcagatacaagtggtagaaattatttggtttttattaggcaagcacttttcatttttttcttggattctctgagatgcaggtatgacgttgagacataagttgccccagggagctttcctgagttgtcctgcaggcttggcataaggtggaaaaacacctgttcttatagggtaaaatgacctttttttgctgtaacatgtagacctctggaatctcagggatgaatggtttaaatgctggagtgaaagcaagtaaacactgggttttgttgcaaatattttgggggcacaatttctttttatgttgaagaatggtgtacattttaagctagaatactggtgaagagccccaatccttacaatacatcattagcatttcaccttgctcatctgtttgcaaaaacttctgcttctgcttttaaacaagtccacaggatatctgtcatctataacattgctggagaatgtaatgttgatgtgctagatgataatcagtatctattaaatgaggaatgatatctcaggtgactggcatatgataggtaattaatgttattggaaataacaaaaataaccaaaattgcaatattaatatttctggatcactgacttagtgccagacacattttaagtgttttacctgctttaacttttttccacaatacaatataaagctggcaaaagtacacataaatatctctatcaacattctggtatatttttctatcatttgctgcctgattttattaaaaaaattctaaattgtgtattctttttattctgaccctctgcagtctaattcattgaatatcttggaaactttttaaaggaaggaaatataatcagatctctccatttgttaactctttttagtagcttcccaatgccataataaatatttcaagatcctaataattatttggctccaacttgcctcttcagaatcatctgtttcttagtattcttctgcaaactaaacttgaagacttgagaactgtctttactactttgcctgcttttccttttgtgtcttcctctccccctcattcatcacctatttcttcacacctttcagttctcatcttgattatccatgtctccagtatactttctgttatcccaactggatatatccttgttattgtggtactgaagataatgcttttcacacattttattacttgcttatattttatctttcaacatagagtttaaggaatgtggggacagaaactatgtctacttttcttgtcttcttaaaatccaaagcagtggtttgtgtgaagcactttataagtattctttggttgaataactaatactttcttatatgttgcaaaatgaaggctttaatttgaacattactaggttcagatagtctctagtagtactcttttttctgtagtaataatgaaattcatataattgtgatgatatagaaataggaatctttaattggcatctggtttaccccacccactaaacatctttctttcacttcaagcaaaaacactgaaagaagaatatagtatcattcccaccaaaaatttaagacaaacaaaacaaaacaaaacaaaacaaacaggtttttttttttttttttttacctttggcagggattttgcaggtttgccgtgaagttttccaacaaagtgaacattttgtaagtgtgggtgaggaaattaaaaattcctgtagttttgaagaagctttgtttcacttttctccattatctcagataatgtagtattttttcataatgggaaaaaggaaaacaaaggcatatgacacaagataattgttatgagaatacaactgataattatctgaaaggagttagaataatgtagccaaagatatataaattgtctatgcttagataaaacaatatacatgtatttatacctggggataatttagtttttgtgcattatctattttgctcatatgtatttacaagaaagaccaagtgctaagagaattgtgggagaaaacttattcttctatcacatcagtgtattcgccatcgtaaaccataattaaaataaaccttagagaataaaacatgcatttgtttactctataaagcagcaatagtaatagatatacacttaaaacaagtctttgaggtccatgatcaatggattctactctactcataaaaaacaattttctaagaagtactcaatttttttcaaaaattaagctagtcccttgatcttttgttcttcaagtgaactgttgagtattttgtgagtatggctgaaatccttgtacctactactgctttgggttcatgctaaggtcttaataatgttagattttaagtaaacatattgtcaaatagcagctgaaattttttcagaaattattgaaatagagacttttgcctaacatggatttcactcatattgttcttagtgaagagacatagttaaaaaaaaaactatacagaagtaacttgatgttcacatttcaacagatgtttgactttaagacaaatgattttcaatcctttagtgaaggagtataaagatactagaaacttcaaattacctgcattgatttttgagtctttgatagagaaattgtatcgttcaattgtgaaggaaacattatggtactgtgggaaaatattttaatttctaaataagggacctgagatacacaattcaaaacaatcccctcaatgctaactagatagttgtgctagaaaaatgcataactcctcaatctacatgtctgcattcagcaggatgtttcttgatgtgtctaatgacttttcttaaatgaaaaatatgtcaagtaaaatggatgtgtgattgctgaaagaaatcctaatgacattaatttataggtttatgagttcctggagtgtgctgtattagtgatgaccacagggttctaacagatgctataatgtaagtctttccataatatttgtgagattgatagattattttatattttcatttcctcatttcttttattgaaaaacagtacttctctgactttatacgtacttaccttctgttttagttaattttcacactgttgacaaagacatactcaagatgggataaaaagaagtttgaaggactcacagttccacgtggctgggaaggcatcacaatcatggtggaatgcaaagagcaagccacgtcttacatggatggcagcaggcaaagagagagaacttgtgcagggaaactaccccttataaaaccatcagctattgtcagacttattcactatcatgagaacagcacaggaaagacctgcctccatgattcaattacctcttactaggaccctctcacagcacatgggaatacaagatgagatgtgggtggggacacagtcaagccatgtcattctgcccctggcccctcccaaatctcatgtccccacatttcaaaaccaatcatgccttacagacagtcctccaaagtcttaactaatttcagtattaactcagaggtccacagcccaaagtctcatctgagatgagacaagtgtcttctgcctatgaacctgtagaatcaaaagcaagttagttaattcccagatacaatgagggtaccagcattggataaatacagatatttcaaatgggagaaattggctaaaatgaaggggctacaggccccatgcatgccagaaatccaacagggcagtcattaagccttaaaattacaaaatgatcttttttgacttcatgtctcacatccaggtcacactgatgcaagaggtgggtttccatggccttgggcagctccacacctgtggctttgcagggtgcagcctccctcccagctgctttaaagggctggcattgagtgtctttagcttttccaggtgcatggtgcaagttgttggtggatctaccactcaggtgtctggaggatggtggcccttttctcacagctcctttaggcagtgtctgagaagcaactcagtgggagttccaactccacattttccttcttgaagtccctaggctacacagaatactgggacgatttttttctttctagcccaccaggcctgtgatggaaggggctgccgtgaaggcctgacatgctctgaagacatttcccccattgtcttggtgattaacatttggctcctcattacttatgcaaatttctgcagccagcttgaatttttcctcagaagaagttaactcttatggtttaatgtaaacacagtatattaaaagtctaagtatgtgcatggcaaagagacaaacaacttgctctttacttgagtctttaatgtcccttttatgtttgtaaatgctattatccaggtagtatcaataattttgcgtggatgagtcacttattttatgtaatatattttacaatagtgtcaagaacattcacagtgagaagttcctttagttctgcaatcactttgagatggaattaaagatgaaaataattatatgagtatatcagcatttcttggatattgtgcttcaaggaattttttggtaaaagttgacatataattgctatgctatacaatttactgattattttgtaaaatccattatttgtggtatattcacagaattgtacatccatgacaacaatcagtttcagagcatttttatttgtatcacaaaataaaccctgtactctttagtattttttcctcaccctgagtttctgcatttctcctgccctgctcaattgctaattaaatttgtatctatagatttgcctattctggaaattttaaaataaatataatcgtacaatatatagtttcttgtgactggcttccttcatttagcataacattttaaaggttcatttatgatgtagcatatgtaaggacttcattcctttttaatggcaaaataaacattttatatatgagcatacacattttatcgatttatttatcagttgatggacattaatttttccctatttttggctagtatgaataatgatgcttatgaacaagcttagtgtaactgtgttttcatttctgtcagatacatattcttagaagtagaattgctgtgttgtgtttccttgcatgtttagctataaaaggttaaactgtacgtgtaaacttttgagaaattgctagactgttttccaatgtggttgcaccattttccattcccatcagcaatgtgtaagtgttacaatgtctccacatcgttttcaacaaatgattatgtgtctttttattacagctaggctggtgggttgaagtagtgtcttgtggggaaaagaaagagagatcagactgttactgtgtctatgtagaaagaagtagacataagagactccattttgttctgtactaagaaaaaatcttctgccttgagatgcagttaatcgataacactagccccaaccctgtgctggcagagacacgtgctgtgttgactcaaggtttaatggatttagggctatgcagtatgtgctttgttaaacaagtgcttgaaggcaatatgtttgttagaagtcatcaccactctctaatctcaagtacccaggcacacaatacactgcggaaggccacagggacctctgcttaggaaagccaggtattgtaaaaggtttctccccatgcgatagcctgagatatggcctcgtgggaagggaaagacctgaccgtcccccagcccaacacccgtaaagggtctgtgctgaggaggattagtaaaagaggaaggcctctttgcagttgagataagaggaagtcatctgtctcctgctaatccctgggcaatggaatgtctcattgtaaaacccgattgcatgttccatttactaagataggagaaaaccaccttagggctggaggtaagacatgctggtgacaatactgctctttaatgcaccgagatgtttatgtatgtgcacatcaaagcacagcaccttttcttaaccttgtttatgacacagagacatttgttcacatgttttcctgctgaccctctccccactataaccctattgtcctgccacatccccctctcgagatagtagagataatgatcaaaaaatactgagggaactcagagaccagtgccagtgtgggtcctctgtatgctaagtgccggtccccagggcccacttttctttctctatactttgtctctctgtctctttcttttctcagtctcttggcccacctgacaagaaacacccacaggtgtggaggggctggcccccttcagtatctcattgttgattatatttccttggtgtctaatgatgttgaacattttgactttgcttataagccactgtattttttttcttttttggagaaatttctattcacatccattgcccatttttaattaatttctttttcttattaagttgtaagtcgtatttctgatacaagtacttcattagttatatcatttgaaaatagattctaagattatgtgggcttttgttttcttgatgctgtcctttgaagcacaaaagtactaaatttgataaagacctatttatatatttttcatatttgattgcttatgcttttgatgtcatatgtaagaaaccactgccaaattcaaagccatgaagattatcttctgtgtgttctttttggaattttatgattctacctcttaaatttaagcctttgacctacttttagtagttttgtaaatggcttgagaccagaagtcaaactttattcttttgtttgtgggcaatccgttattcaataagcatttgttcaagactgttcaattttttcattgaattgttttggcatctttgtaaaaaaccataaatatgtgggtatgtttctgggttctaaaatctattttgtttgtatatatgtctatttgtatgcctataccaggctcatttgattattatagatttgtagttggctttgaaagaagaaagtgtaaatcttccaactttgttattattattattattattttcagacaggatcttactctgtttcccaggctgaagtagagtggtgtgatcatggctcactgcagccttgaactcccaggctcaagcaatcctatcaccttagcctactgagttgctaggaccacaggcatgtgtcacctctcctggctaatatattattattagtattataaagacaagagtctccttatgttgcccaggctggtcttaaactcctttgctcaagtgatctacctgccttggcatcacaaagtacaactttgttctttattttaagacttttttggctatctttaggtttcttgaatatctttgtgaatttcagaattagtttgtcaatttactggaagaagccagttgggattttgatagggattgcattaaatctgtatatctatttggggagtggagtatggacactacaacaatactgtgttttaatctgtgaacatgagatgtctttccatttatttacatcttttaaatttctttcctctatgctttacagtatccataatgcaagttttacacttattttgttaaaattgattcctaatagttatattcttttggatgttatttgaagtgcaattgttttcttaatttcattttggatatttcattgcaattatgtaaagtaatttttttgtttattgatcttttatcctgaaaatttgctttgtttattgttccaatattttttctagcagattcctaaagattttctagatgtaaggtcatgtcatatgccaaaagtttaacttctttcttttcaatgtagatttatttttttcattttcttgcctttatcttgactagaagctccattaaaatattcaatatagataaagagtggatttagtctttctccattaagtatgatgttagctgtgcattttttacagataacacttaccagtttgagaaagtttccctctatccctactttacggggtactgttataatgaaggatattgaattttattaaattaatttttctgcatttattgagatgatcatgcagttttatttttctgttctaattacattttgtattatgttaatagagattttaacgttaaagcaactttgcatttttaataaaacttttacttattcagggtatataattgcttctgtatattcttacattcattttgctagcaaattttgtggatttctgagttcataatcataagatttatcgatctgtagtttttattttttgtgatatctttgtgtggttttactagaaggaattagttaaatatgttgataatgcatttttcttttctgtgatttgaaggattatttttgaggaattgttaatttttctgctttaaatgacttatagatttcaaaataaaggcatcttgacctaggcaattctttgtgggttgtattttggaccaattcagcctctctttttgttataggtctattcagatgttctgtttctttttgaatcagtttaatatattttcttgtctgtgtcttcctgtagtagaatttatgtcaaattaagttgggagtgggtgagggagcagttcatggttgaaattaataggctctcattatttttaccaggacttagtagattttcttgaataaatattgctaatattacgctttataattttaggtcaatgcctggacactttaattttttatagaaaacacaatattttaatgctaaagatgtgtttaaattgtttcttttttacaattgtgatgttctatgaagatttaaacttttgactgttaacagatgatttaaatagaaatgtagcatatgtactcagtgtacatgtgtatattcagcttgtcagcattgagttatctttcataaacttatatttatttatttgacacaaccaggtgggaggggttcccagagaaacaccagagagcctgtgcactgggaggagtgcacactggggtggagccacagaagttcatatgatttgcagtgaggaggagcccggcccctcctcttcttggatggaacctggaattcagtctgtgaggtggcaaacccaccggcaggaaaacacactctctcacttcactaagagcctctgttttgccttttcttcctttttacctaacaaaactctgcattattcaccttcaaagtccgtgtgcctaatttttcatggccatgtgacaagaaccttgcttttagttgaactaagaaaaagtcccacaacatatagatacacacacacgcacacacacacacaggcaaaaatgcaaaaacattcctcattttattttgttttacagatatggtcttttttacaaattgaaagcttattgctgccctgcattgggcaagtttaccagtgccatctttccaacaggatgtgctaactctgtcactgtggcacattttggtaaatttcacaaagttccaaacatttttattattattatatttattatgatgagttgtgataactgattgttgattttactgtagtattgtgttgcgggcaccagaaactgtattgggataatacgataaacttaactgataagtgctggtgtcttctgactgctctaccaaccagcctttcccccatttctctctctctccttaggcctctctatttcccgaggcacagcaatgttgaaatcaggcaaattagtaatcctacaaatggcctctaaatgttcaagggaaaggaaggctctgtcatctcaatatcaaaagctggaaatgattaaacttattaagaaaggcatgttgaaagctgatacaggctcagatctgtacctcttatgccaaatagttagccaagttgtgaatataaaaaaaaaatttgggaaagacattaaaagtgctacacatgtacacatgaatgatatgaaagtgcaacagccttgttggctggataaaagatcaaaccagtgacaatagtccccaaatttagacaaagcctaaaccagaacaaggccataattctctccaatgctgacaggggtgaagaagaaatctttgaatctagcagtggttggttcacgaagtttaagggaataaaccatctccataacataaaagtgcaaaataaaagaagctacagaagattatccagaagatgtagccaaaatagttactgaaagtggccacactaaacaggagatttttccttgtgtacagagcatctttctcttgaaagaagataacatttagcttttttatatcttcacaggagaagtcaatgtctagcttcaatgcttcaaaggacaggatgactctttcattagaggctaatgcagctggtggcttgaagttgaagccaatttttttttttttttgagatggagtcttgctctgtcacccaggctggagtgcagtggcaccatctcagttcagtgcaagctccacctcccaggttcatgccattctcctgcctcagcctcccgagtagctgagactacaggcaaccgccaccacgcctggctaattttttgtatttttagtagagacggggtttcactgtggtcttgatctcctgacttcatgatccacccacctcggcctcccaaagtggtgggattacaggcatgagccaccgcacccggttgaagtcactgtttatttaccatttggaatatcctagggccttagataaattattctaaatctactctctctgtgctctattaatggaatatcaaagcttggttgataacacatttctttacagcataaattactaaatattttaatcccactgttgagatctattgaccagaaagaaatattcctttagaaatattagcattcattgacaatgtacctggtcacccaagagctcttatggagatatacagggagatcaatgttgtttttatgcctggtaatacaacattcattctgtaacacatatatcaaaaagtaatttcaacttttaagtcaattaaggaataagtttcgtaagattattgctgccattaacagcaatttctctgttggacgttgtcaaagtaaattcaacactttctggaaaagtttcacctttctagatgatattaagaacatttgagtcattaaatgaagtaaacatatcaacattaacaggaatttggcagaatttgatttcaaatatcatagataatgttgagagcttcaagaattcaatggaagaagtaaccacagatatggtagaaatagtaagggaactattactggaattaaaagaagaacctgaagttgtgactgaattgctataatctcatgataaaacttgaatagatgagttctttcttatggatcagcaaaaaaatttggtatagtgagatagaacctactcctggtgaagatgctgtgaacattgttgaaatgacaacaaagtatttagaatattacttaaggttatttgataaagcagcagtagggtttaagtggattgattccaactttaaaagaagttctatcatgagtaaaatgctaccaaattgcattgcatgctgcagataaatccaagtcaaaatcacaatgagatgctaactcaagccagtcagaatggctatttttaataagtcaaaaacaacagatgctggtgagattgtggagaaaaaggaacacttttacactgttggtgagagtttaaatttgttcaaccattgtgaaagacagtgtggtgattcctgaaagacctagaggcagaaatataatttttcccagcaatcccattactaggtgtatacccaaagtaacataaattgttctattataaagacacatgcatgcatatgttcgttgtggcaatattcacaatagcaaagacatggactcaacctaaatgcccatcaatgacagactggacaaagaaaatgtggtacatattctccttggaatactatgcatccctaaaaaagaatgagatcatatcctttgcagggacatggttggagttggaggctgttattcatagcaaaataatgcagaaacagataaccaaataccacatgtcctaacttatatgtgatagctaaataatgagaagatatggatacatggggggtaaaaacacacagtggggacttttggaggtcaggggatgcgaggagggagaggatcagaaagaatagctaatggattctaggcttaatacctgggtaatgggatgatctgtgcagcaaaccacgatggcacacgtttaccttgtaacaaacctggacatcctgcacatgtaccttgaactttaaataaaagttggaaatttttaaagaaggaaggtcaatgggtgcagcaaacattatttttgtctttttaaaagacattgccacagctccccaaactttcagcagccaccaccctgattagttagcagctgtcatcatcaatgcaagaccctccacctacaaaatgattacaactcactgcaggctcagatgattgttaggatttttaaagcaatgaagtattttcattacagtgtgtacattatttgtaacatatttatattgcagacttaagagactacagtatagtgtacacataacatctatatgccatggaaaaccagaaaattttgtttgacttactttacttcagtgttctgggaccaaatctgcaatatcttggaagtatgtcttgtataagtgaacataaaatgagatctactcttttaaaagtattttaagtgtatgatacattattgttaactatggccacaatgttgtgcagcagtgctctgaaacctgctcatcttatttttactggaactttatactcattgaaaagcaactctcaatttcctccattctccagccactggtaacctccattctactctccgtttctttgagtttgactgtttcaaatttcttacacaagtagaatcatagagtatgtgtcccattgagactggcttatttcacttaaaattatttcctgaaggttcatctatgttgttacatattgcaggatgggtggatcatatggaagttctatttttaattttttgagcaacctctacactgttttcattttggctgtaaaaatttatattcacactgacagtgtatgaaagtttcaatttctccatttcctagccaacaacttttattgtgtgtgtatatatgtatgtgtgtgtttgtgtctgtatgttgataaagacatggtaagaggtatgaggtgatatctcattgcagttttgattttcctgatgatgaatttacattaattagttttcatacagctgttgtccatatgtacaacttcctcagagaaatgtctttttcaagtatttgcctatttattaatcatggctttttttctctttttgctattgagttgttgcagttcctaatatattttaggtgttaacctctcatgagatatatgatttgaaactgtttcccattcccattttatcttttcactctgttgacttctttgccctgcagaaactttttagtttgatacaattctactttcatatatttgaccttgttacctgtacttctgaggtcatacccaatagaccattgcccagcccaatgtcataaaactttttccgtgttttattgtgagagttttatagtttcagggcttatgtttaagtctttcatttgttttgtgttgatttttgtatatgacataaactaagggtccaattttattcttttgcatgtggacatctggtgttctcatgcagtaccgtttcttgaagagagtgacatttattgagtatatttgagactcattgaatataagtgcattgtatatttgtgactttatcatctgggctctctattctgttacttaaatctctctctatttatgtctttatgtgaatatcatgttattttaataactgtagcttttaatatattttgaaataaggagatgtgatgccctataactgtgttttacttttcccacattgttttggctagttacttcttcctggatcattatacattttaagatttttttgtctttgtataagtcattggtgtttcgatagagattacatttaatatgttaatcactttaggttgtatagatgtttctgtaacattaaatcttccggtcaatatactatgtctttctaaattagtataatctttaatttcattcatcagtgttttgtagtttttagtatacatgtctttcttccacttgttacagtttattcttatgtattttgtcctttttgaggccattgcaaattggagtgttttgttaatttccttttctgatagttctttgttaatacacagaaaggtaagtgatttttgtatgctgattttatatgctgcaaatttactgaatttatgcacttgttctaataatatttggtggcatctttagggttttccacatataatatcatgtcctctgcaaacagaggttattttactgttgattcagaagcctgttgctttttttctttttcttgcctaattgttccggctaggatttccagtatggtgtataatagaagcagcaagagtgaacatcctttccttattgtgaaaacagatgaaaagttttcagtttttttttaatcattgagtatgatgttagctatgagcttttcatatattgcctttatcaggttaagataatttccttctatttcttgttgcaggaagtcagggaccctgaatggagggactggctggagctgaggcagaacatcataaattgtgaagatttcatggacatttatctgttccaaaaattaatacttttataatttcttatgcctgtctttactgcaatctctgaacataaattgtgaagatttcatggacatttatcacttccctaataatactattataatttcttatgcttgtctttactttaatctcttaatcctgttgtcttcataagttgagaatgtatgtcacctcaggaccactattgtacaaattggttgtagaacatgtgtgtttgaacaatatgacatctgtttgtaaaacatatatgtttgaacaatatgaaatcagtgtaccctgaaaaacaacagaataacagcaattttcagggaacaagggaagataaccataaggtctgactgcctgaggggttgggcagaataagccatatgtttcttcttgcagaaagcctataaatggatgtgcaaggaggagaaataccgctgaattcttttcccagcaaggagtaaccctggggaaggaatgcattcctggggagaggtctatgaatggccactctgggagtgtctgtcttatgcggttgagaaaaggactgaaatatgccctggtctcctgcagtaccctcaggcttactaggattgggaaattccagcctggtaaattctagctagactagttctctgctctcaaaccctgtttcctgttaagatgtttataaaaacaatatgggaacagcaggacatagagcctcatcagtaattctaattctgcctttgccttgtgatctatatggccctttgaagcatgtgatccttgtgacctactccctgtttatacaccccctcctcttttaaaatccctaataaaaacttgctggttttgcagctcagggtcgtctgcacagtcctaccaatatgcgatgtcaaccctggaggcccagctgtaaaatttctctctttttactcttactctttatttctcagaccagtcaccaattagggaaaatagaaaagacctacattgaaatattgggggcttgttcccccgatatcatttctatttctagtttgtttagagctctcttttaaaaactcataaacaattgatttttttcaaatgctttgttttgcatttactgatatatcaagtgatttttatgcatcattgggttaaggtgatatgtcacatttgctcatttttgtgtgttctattatccttaaatctagggataaatttgtcatttcttttaggaaagaagcaatgctgagtcttgaacatagtaaaagccaagcaacactactggtcttgtaatatcaaaaggaagagtgagactttcttcacaatttaattattgagtagtttctttgcaacagtaaaaacaacaaaattctgctgaaaatgaaaccaaagaattctgagtatttgcaaaatggtattaatattgtgaacggatgtcttaatattgggtcaatgtataaagtgtgaaacacagctcagtaatttttgtgcatgtgccacttgtgaatagaataatgtatttcacataaacccatatggttttacattattttttatttttccttgtttttaagtatttgactaagaatatttctaacttttaaataggtactaaatctctggaaaataaattttgacctaacagtgtaagttataaaaatatgttttgtcacaggaggaaggaaatcctctgtatcaacctcttcatgctggaattaactgaaggaattctatcttttggtcattccagcttcaagccttttatgtaactaatcccttttctccttctttcctgttttagcaaactttcagaaagaaaacaggcaacatcttgtgatgatgaagatcacagttgacacataggccagcaggaacctaatcacatgcaagttgtggtattggaaccaggtgaggtcgtgggctgcaacccgaaggtgcttggctcctttgtgctgcatgacaaactcaatccagaaggctgcttgatccaggggcttaattggcaaatcatggcgaattattgataacttcatagcattctctttgtagctgaaggataaacataaaaataccaacattgaaagtaaatttatttcctaagtctatggatggtctttgaaaagtgtcacatcaatgcttcaaagtaaatattatagaattgtcataggaatcgaatgttttggtttggacaaatgtagaaagtttattttttaaaatggaattttataaagaaaaatatgtcttaaattaaaaatggaaggtctgatgagaaagttaatgtctttgtagcagaggaaatattttgagccattctatgtgctacaggtaagacagtggaaatgcaatctgagattgatcatcttgatattttattttatttttttttgagaaagagtctttctctacggcccagattggagtgcagtggcatgattatgggtcacagcagcctccacagtgtgggcttaaacaatcctcccacctctgcctcctgagtagctgggactgcaggcatgcaccactttgcccagtaatttttaaatatttttttgtagagatggagtcctaccagtttgcccaggatggtttcaaactcttgggctcaagtgatccttttgctttagccttccaaatttctgggactacaggtgtgaactacctttatcgacccattttgatatttttaaggaaaaattgtttcacagctggtgtaatatttctaaattagtctttctctttctaccctactattctgtgttctaccatattttcctctcagtagtcagaataattttttgaaataaaagccagattatggcattcctctgataagattttcacctggcttctcactatattaagaataaaatctaaatctgtctttgttctacagaaccctacatggtcaggcatgggcaacttcttctaacactttccccaaccaccttctctcctagaggcattgcccttctattgttctttgagctccccaatgtgttctcacctgagcccctttacaccctttatcccctctctccctctcttggaatattcctccttgcaacaacttgaggcttgcttctatatctttttgaggcttccccttaaataatacctgttaaagaggcttttcgtggccacactatggtagtacctgtaggatttcctctattgttttgtgcttattttgctgtttaactcctggaacttaaaaatatgttacatgtcttctcaaataaaactttaagtataaaatacataaatgtacacaaattcagtgaatagctcaaaattttaacattaccttgaacaatatcctgatgtgaacaccaacttacctactacgcagattataatataagacatcacaacctgcctagaaaaactctgtcttcttgggccattttagtcactacttttgtcctcaagttaaaactaccttgacttctaatagattaatattgcttgtttacataatgaattatataatatatactcatttgtgtctttttttgggtagaagttattggctaattccattgctgtaatatgattcagtcaattgacaaataccacagattatctcctatttttatgactgatggatatttgggttgttaagatttttgaacactattactaattctggggtaagcaaatgtgtgtatatcattagatatacatattaatacatttttgatgggtatatacttgagagatgagttgctgagaaaaagatgcatgtagaattatgatgttttgttgactagctttttaaatacacaaatttaatttccaaaatttagagttgttttttaagttataattttttggataatttcgaatttatttctagtatggctagagcatttcctttttatgcttttgaatcttatcacatttgctaagtcctgatttttggcccagcagaagttcaattcactaactattccatatactcttaataaacgtatattctcaatatacattcacactcacctccacacctccacacataaaaatgtgtgtgtatatatatatatatacacacatatacacaaacttactatatatatacacaatacatatatatgtatacacacacatatatacaataggttatatttatgctcttcaaatgtttatttttaagtcacttttttttctctgtttaaatttagtatgagttctagtagattcacttttaaatctactatcttattctgtattttattttctgttttccaatctgctgtatgtttcttttctaattctttcctgtttgcttttaaactatttttaatcattcactgtcttattatcttcctggtaaggtattttcagtatattttctaaggtggtacctccttatatatattgataatagtaatcaatagtcacagcattttctacattatttcttttggagcacagaaaaattattacagatttattttctcaatattaaaactttgtgcttcaagggacatcttcaataaagtaaaaaaaaagaatcaacctataaagagtgggagaaaatatttaaaaatcatagactgacaaggcattccaccaataatataaaaataattcttatgaatcaataataagataaaaatgttagaaatgttcaaaagataggaataaaattttctcaaaagaagacgaatgacttgccagtaagtgcatgaaaagatggttatgtctttagccacaaggaaaatgcaaattaaatccacaatgaaagatcattttatatccactgggatccctgtaacaaaaagataggagataacaagtgtagggaagagcatgaagaaattggaaccctcctgtacagctagaagtaacgaaaaacggtgcaagtactttgaaaaacagtttagcagttcttcataaacatcaactttccatatggctcagaaattccactcctagtatcttctcaaaattagtgaaaacaacttttttcacaaaaaatatgtatagcagtgtttataagagctaaaattggaaataactgaaatgtctgagagctgataaatgggtaaattcaaaatggtacattcatcaaagaatattagcaataaaaagaaaaaatgttctgacactttcaacaatatgggtgaaactaataaaagacattgtactaagtcaaagaaatcatttatagaacactgtaaattgtatgatttaatttacatgaaatatccagagagaataatctattgagaaagtaagttgatatttccctaggactggaggtttatcaacagtgattttatgcattttgaggtttattttagggtgataaaaatgttcaaaaattatattatggtgatggctttgtaactatgtaaatgtactaactacttttagatctcacttttaaataggtaaatattatgctatgcaaattgtatcttaaaataatgataatactaaaaatacattattgagcatgaatacagttatactttcagaaattttatgtattgaattgaaatactttattttatttctccaagttcattatttcattgtattataatccatcattcaaaaaacttatattttaaacaattatctatatatgtttaaaaatatttgtgtgtagaaggttgttacagtaattggtgacccattaaatatatgggatcaaatgtaactaaaataattggtgaaaaataaaagcaggtttcaagttggttaaattatttaaattctttcaaaattggtctcctaaaaggggtaagacatgtattcagtgttgtcaaaagaatctgtaaataccacatagtaaaaaaaattgtcatactcacacagggtcattaatgactgtcttcagtgcattgagcaaatctgtacttgacatggtcctgatgtccacattgagggccttcatgtgagcaatgttatcaggttgatctgcaaacaaaggaatgcccaccatagggatcccatggtagattgcctcatagatgccactggtttcaccatgagtcataaaagatttagtttttggatgacctaggattggataaattttagcaaaattattcataagactaaaatgagaaatgcacaatagaatgctctgaaaggggcagtgtctactaaataacagattattatacacatcaaactccattagaattgctttcggatttcagagaaagaagcacctaattcttctggaggtaagtgaaggctacatgaagaggtgggggcgtgtgtgacttcagactcaaaaaatgaattgatattgccaggtggacaaaatgaaaaagcacattctgaatgaaaaaaatgtgcaaaaaaaaagagaaaagaaaatcaataatattgtgtatgttagagcattttcccttaaatacatactgcggtctgagtgggatatgtggtgtatgcaaggcaacagggagtgtggtggtggtattggaatagaagaaaggcaggccacattacatcaggaaacgtgttatcactttatgataaagattgaggatttaggccgggtgcggaggctcatgcctataatcccagcactttgagaggcagaggtgggtggatcacctgaggtcaggagttcgagaccagcctggccaacatggtgaaacctggtctctactaaaaatacaaaaattagagaggcttggtggcaggtgcctgtaatcccagctactcgggaagctgaggcaggagaatcgcttgaacctgggaggtgaaggttgcagtgagccaaggtcatgccaatgcactccagcctggggacaagagtgagacttcatctcaaaaaaaaaaaaagattgaggatttattttcagaaaatgcagagttattggtaataaaagaggcactgttattttttagtgtcttttgaaattaaccctgaagtagggaaaaggacaggtgtaaagctgtacaaataggagacagagagacaatccaggaagttattgggaaaccccgtgagaggtaattatatctgaaataaagataatttgattctgaacataaagaatgtgagtgtctataataaaataccaactatatagttattttcctggtaagactggaaaataaatataaagtagttagcctttatatttgagttttttgataataaatgttccgtaagtttctttcaggttgagctatccttctaattagctgttagtcatatattcagtatttgttctgcagagtattaccaagaaggtcattctgggatatccacttgtacagctgagtattggatgctaaagtatttggtctctttccatccacagaacctgttggggtaaagaaaatatcttgttccatgagtagaatgccaaagctataagatgttagaactctaaagaaattgtcaatcaactagttaaaccccttccatataatagatgaaaaaacgagaacaagcaattttaggaaatgagtactactaaaagactattgaatatccacatttcatgtcttttattatcaatttggtatattagaaaatcatgatgttttcaacagagaagcttagacacttgagagtatcaataaaaaattcaaaaatttaagaaattattagacagtcattataattctactgtaaaatacagtaacaaattagtgacaacctatacatttattttatgtattttatactacctgtaatcttccaaatttaatgttagtttatttcttgagtgaaatgagaagtgttacttatatatatttttctgtaagttattttgttagtgtttgacatctttgatttataaaaaacaaaatctataaaatcagctacctgtgagaaataaatcagtgctacataggtagtacatataacttcttgtagattacacattacccagcactacatccaagaaaaatttcaagtgacaatttctttcttttcttttcttttttcttttctttctttttttttttttttttttgagatggagtcttgctctgttgcccaggctggagtgcagtggcaccatctcagctcactgcaaccctcgcctcctgggttcaagcgatttttctgcctcagcctcccaagtagctgggattacaggcatgcactgccatgcccagctaatttttatattttttagtagagacggggtttcaccatgttggccgggctggtctcgaactcctgacctcaagtgatctgcccacctaggcatcccaaagtgcaagtggcaatttctgagtcaaattcaaagtactatcattttgctagttttggaaattcttccaatgtaggcgaaaagagccaattggcaatttatgaataagaatatacacactaaaaattgtaaaattatattttgctaaattttgcttaactgatcattaacacttagatgctgctataaagcatcgacagcatagattaatatgggctgctttagccaagccatacccatagacagtaccaaaataagatactgattttagattccccaagcaatccttataaactggagtgtaatttacaagtgttttccttgtatttgctatgtgagtgttaaagtaactttgtgtttccagaaaaaaattagcataggtcattaggagaaggctatgtcagagaggaaactaaaaagtaactcacaaatacacaaagacttcaagtgtattctgcatactacaaaataagttcctactatatttcatggagtgagggcatctgaacctctttccatgcctggcttccttctgcttgactccttcttatattcccttctccttcctccgttgggaggaggtgtttttctgatggttagagcagaggctttatgggaccacattttataatgcacggagtctaccctaaaagcaggattctgttccttccttttctatcatattttcctgtttaagacattagcaaggcccagtaaacagggcaggcaagttcttctgcttctctaaatctacttggctaggtggatacctccagaatagcggtttgtcagcctggacatcttttctctgaatgcattctgaattgcctactaaataggtctattccaaaatgtacaggaagtacaggagaccagattacctagcaagcctaaattgaatgatgcatttcagacttttttcaataccttattgttattgtaatagtgcagtaactgattaaaatgtaagtgattttaaataatatctatagtgtataccatgttctcaggaaacttgtaagcaaaagggacaaatgacagggcagaatttggtgatttctatgtacatgcctacaatactatgataataccacaacttcacctgcacctcttaaatatattttttctgatcacaatattaatgtcagaatttttatcaatcaaacacaccctcgttattttagtatcttccatatatatttttgtttttgaaccaatatctgagataattagagctatcatatcagttagtttttctggcagaaaatttctgtgattggactctttacagagtttaacagactcattcagtagctgtccaccattaagacattttatctaacctttcgtggaatctgggcaagagctgatgcaatcacgttggccctttcttctgtgatgttactgaccatagacttaagcaagactgccacgacaccattttctccagagctctgcacaaactcttccattttctgtgaagaatttgttctatcacaaaagagtgtcagcatagcaaacactatagaaaagattagtacatacatctaagaagagaaaatcaagcattatcagaaatttttggagtaatggctattttttaactgacctaatctctttctttggaagaagttatggaatatgatatacatggcatctgttatggctatttgtgtaaatatgtgtgtctgtaaaaggaaaagatgaaaaacaactatgacactatagaagaaggagacaatgctagaaaatattatacccagactcttcatttacaatactgtaattactaatatgggttcttggaaggtggcatttgttgtgtttaattccatatgttgtagttctactaaattccttgtgtctattaaggcagggttttttgtttgtttgtttgtttgttctttctgtagagtatttttagttgggagtcattggaaccattacctggctatgagcagtgaggaaaagttactattgaaataattttatatgtctatttctttagctctgtaattctttatacctcatttaaaacttgtcagattatgtctttttccctaaaaaaaaatctttaaaagctgaagtttaataatgatggagattcaagagtctgatactgtggtgtgaaatttctgtgaactagtcctgagaatcccatttataatacagaattatgcagtatatagttacataactgagtgattgtatttctcaggtcattgtttaaatattactaagacactttttttcctgaaatcacactgcataaaatgatatgctactggccaggcatggtggctcacacctgtaatcctagcactttgggaggtcgagatgggcagatcaccaggtcaagagattgggaccatcctggccaacatggtgaaactctgtctctactaaaaatacaaaaattagctgggcgtggtggcacacacctgtaatcccagatactcgggaggctgcggcaggagaattgcttgaacccgggaggtggaggttgcagtgagccgagattgtgccgctgcactccagcctgggcgacccagcgagactccatctcaaaacaaaacaaaacaaaacaaacaaaccaaacaaacaactgatgtgctacctataactgcctgtgagggaccctcatcatcacttttctgtgtctcacaggggcacttaatcctcagtggaagaatctaccagtcatttttccagtggagatctcttcactatcttgagtagctcattcacacaatataaagcccttgttgaatatgtgtttgcttgaaatttattgagaattactctgaattgtggtttcccttatgttctcatttgtaaatgtaaatgcatagtgtaattccacattgctcagtgcatacgcctatcaagacaaaataaagagaaagagaaatgtagcgccaaaagttttcagtatataatgtcaaaattgaatacccatctttttgttgttgttgtttcttttgttttccatttattatttatttattttctctgtaaaataatgatgaacccattctgacataaccggtatactttcagatcctaaacatgggaggtaaactttcttttaaaaacttgtttaaaaaaagaaatcctaaagtttgtgtatgcacaacatattttgccaagtatttttcaaaaatataatttgagccttatgacattagttttaattggagagtcactgtactactattccaggtagttcttggggctcccaggtattctgtgtgactcgttacctgtgtgaacacaaagtatctgaaacagttctcaatttagaaagtttattttgccaaggataaggacatgctcatgacactgcctcagaaagtctcaatgacacgtgctcaaggtggttggggcacagcttggttttacacattttagcagacatgagacatcaatcaatatgcgtatgacgtacattggtttggtcaggaaaggtggggcaattcaaagtgatgccttcatgtcatagataagagttaaaaggttgcattcttttttgggtcttagatgagccttttgctgaatacacagtatacatatgagagaagggttgagaaatagtcacttatgccttagtctgactcagtaaatctgcattttttccataaacaatggtgaagggatggctttgagttctgtcctcttttgtccctcacctgtgaagataagctatcaatttacatttccagggtgaaattcaacagaaatgtttcaggttaaagattttgaggcccacaaggaatttcctcttgggaagattgtaagggaggtatgtaacttaaaaacaacaacaacaacaacaacaacaaaaacccaactttgtagctattttatttaggaataaaatgggaggcaggtttggctgatacagtttccagcttgacttccctttgacttagtgactttgggttttcaagattatttttctttcagacctgtagccacatttaatggaacttgtgtttgatgttttttctcaatgcctcgctgcccagagtcttcttcatccacccaatattgaggtagcatattgtctgtttatacactcatcagtgatctcattctgggatatcttcatgaaaataatatatcagtgtacaaaatattagagtatgaaaagcttaaaaaaattaaatttccctcatactctctgtctagagctattcctgatttaaatttgtatgcttttattatggtttttattctatttatataattcactgtgatgtttatttagataattttaatcttattgtatattccttttcatcctgcataaaaattgtgatctagttctattcatcattttgtttctcagtttccgacaattcttgtattatagctgacactgtaattatacatattttgataaaatgattgtaatggcatagaatgcatattgtatacatttttacatagtacccaatagtttttcaggccttctgcccttctcttccctctgtagtagtccccactgtctattgttcccatttttgtctatgtgtgccccaagcttagctcccacttttaagtgagaacacatagtatttagttttctgtttctgggttaattattctggttcatgtgtgtgtgtgtgtgcacaaatctccatgtatttgtttgtttatcttggctttaatctgtcattttattttcttttttcaaatgttgtctgcctatctatctatatatttatctatctaatctatctatctatctatctattatctatttatcatctatctatatatttaagaatgaggacatagaatgattcactgggatatctttgtatctgtgaaggacttagtatctggttggctttgatttttatgctgaacgcgtacaactactagaccttacctaaagggaaccaaaaatttcataaaaaagattatactttgatgtgttacatcaattctagttttctcattttaccctggtgaatttatttcaatttctttaaggaaaaactctctagtttttgtgtggaaagtgcaaagaggaacgtattatgtaatacagtaagggttagtgcatttcattttcatgtctttagtttcctttagtctgtaattatcccttcattttttgtctctgttaatttttgacttctagatgaattattgaccagttgttttgtagaatgattcttattttacatttgtttaatgttccttcatgattaagttgctatcacacattttttgaaagaatactgcagacatgttgttgtagtcttcacattacatcatttttgggcagcagatagtgttgatttgtcatgctggtgatactaactttgatttcttggttaagatgctgtctacaggtttattccctgtaaaattataatttctcattttggaattagaagtatcttgataggagactttgagactgtaaatatcctgtttccattacatcctttccctctaattttagcatccattcaaagataatttttgcctgaattaaattactgtggagtttgtctaatgattatttctatgtctataatttctttaacaattagtaagagaaattctactctaagaaagaacattttttcccttttatttccttatactggtttctgtcaatatgatttcatgagtatttggtttattccaaaggttacaatccacagctatcattattccattgctcaaattggtccagattcgattcattgggacttccttcagtttccctctatatttttctgatatgttgtcatcatgttgtatacttatttactttctggcacccctagatatttcaggcacatcctgtacttttgttgcctcaggggtaatgtcatttatatcttgaggaaggcatggttcgttttattggagtatagtgtctagaagcaaaatttcaagtacttagcatgttcattgcatctgggatattattacttctaggccatttacgcatagacattttggaaatgtatctatgcataacttttcattaacagcttaagagaataaataaattatcatttccataaaatacagaaaaaggagagtgtagtaagctaaaacatggtaaatctaaatagtaaatatttacagataagctcaaactaataatttaatgtaaaaagttattttcatttaatgtcatgtaatagttatatatcaatttaaaaaagaattaaataaactcacccattatggtagagattctcagatatttcaatctagcttttatttttgtttaaaagagaaacacctaataaaaattacccatattactataaaatatatacagattttacaagaggcatatacccaatagcaaataaatgaaaattgatgcaatgctacaaaaatcaaacaaagcagaattaagatgcgaagtatcaaatgtgataagtgaatcatttcatgtggatagaaataattcacttaaaattaacaataataagtatttggagattgaaatatatctcagaaactgatagattgaacagagaaaataaattctatgaaagttgattgtattagcaacaaaagtaacaaaaataacgtactgaatcctgcatcttcaaatagagtataaatattcttttgaagtgcacatgaaaacttttataaaattaaactaaggcaatgtcacagatgaaatctccacaaattctgaagtatatatatcatatgtatctatataatgtgatacaattaaaataattataaacttaaagagaatgtattacctttcaaatatacacatttaagaatttcattcagtggagtggactgtgcttaccattcatgacccaagtctttactaccttttctgctccaaacacatataccatgaagagaagacggcatagaatatactcaggtaagtatacaactgagaaaacttacacaccagttgttagcattagagaaaattatatgaatagattcttataggagctataacaagatggttttggcaggataaaaaatgtggcaaaagccttaaaagtggaaaacaaaatttacctacggagttcagggaatttctgttctgaaaaaatgtaagttgtaataactaaaaaattaaaacaaattataatgaaactgatctctctagatgacagcagacacatgcaggaaatgaaagtttgcagaaattaacagctgttgaagattaactcatgaaaaccacatgaggaaataaccaattctacacaatagtaagattttcacccaaagtttataaatataggaaaaaatcaaaataattttttttctcagagatgagaaaatacttaacataaaaatggaattgggtgagaagcatgaatagaaagaggaacatttagaaattgtggaaattagaaatacagtcactgattgtataaaatgtaatagagttcacaaaataaaatggaaccgaatgaacgaataaaagaatgaacaaaacctgcaataaggtgaattagtaaactttctctttttctgactgaaccttgactgatagagcttccaacagaaatcacctaatactgtaggaattgccattaagctgattaaaatatgaaagtgttatttgctattaccacatgttagagccctcctgattgcctgctttacttctgaagctctgtcattatggtttcctggttttaatcactcattctatgcttcactgaaatattttgaactgattcaatgtgtttctctcaaatttaattttattctatcctgtctcttgcctcctgcaggttctcactgtgagcaatccagctccagagcttaccttctctgacctagggttcctcatttttttttttttaccagtttatctgaacttcattgatcttgttcctttgccaatcactctgagccactgtcatcatgactcaggattctagaatttgaacaaattataaatttgccctttgtatcttctgtatcccaaagaagaaccagtagacggtaccacaagagaaaaatgagtgcagtacatgaacaaaacacctgaatgaatcacaaacaaaaagagatggttgattagatttataattaagcatttgccaatcaaatcagtgattcatttttatattatttggattggtaaaatttaacatccaccatagatgaagcacgaaataactgtccactccagtgctgcataggtgggtgtacatagagggaggtagtgtttgaaggatacccctgggctcaactgactcaagctagctcagtcttggtaagagggagactggacacttctggtacagttgggctgcagacacactgtaccaactgtaagttcactttggtgagaatcttcatatgccctcacttgaaagaattttcttttccagataagtttatgccttttattcatccgaattttaccatgatgctgtgctcaaagatacaacaacatttgaggcactaaaaaatgaaaaattttaaatattgttgtctgctctaacagttttcaatttactgaaggtggaaattttacagttattaagaaataaagtaaactgaaaaaacataggtggagtgagactgagagaaaaagaaatggagagagtcatggaactcttcccagcagggtgaaaattattggatatttattaagaaaagggatgaatgaaatgaaaattaacatggctaaaaaaaggtctcaacacaacattatgagaggtaaggtggtcaaatgagactttttgaaattaatccaacctaaaagggccccaaactaatcagtttcatttatcgcagtgtggagtagtttaaaaagcaggaatgcagagatcacagttagaaagctgcttaataatttcttcagataatgctgaggcagattaatcaagataaaaattaacacacaaaaaaagggtttattggtttaaggccctgctgttgacccaaagccttgtgtaagactgtcaggggatagggaacagaaattccagagactccttaatacaagaccccatgtgatatgctaccaagatgcattggggaagccttgaccgaggttatagttaggttgagaaaccataaaaatataaagattaatagaattatgaaatttgtgatatttaaacaggcttaatttaaagaaagtgtgtctttttaacttaaatgtcttatgaaatggactttatgtctggctggaaacacttgttctgcctattgataatattgtaacacaaaacctgctgataaagtcctaaaggagcttaagtaaaggttaatgaaatgaaaaggaaaatgtataggaaagttggtatttttgaacatactttatgtgaagtagtatctattttatctgaatgtgtcaaggttgaaggacactgtatctaactaggaaatgtttcttgaatctaatattgtataacagaaggtatgcaaatttgcccttcagccaacattaattggacatgctaaatgaaaaccactatggtagggtggagtcaagatggccgaataggaatagctccagtctacagctcccagcatgagcgacacagaagacgaatgatttctgcatttccaactgaggtaccaggtgtatctcgctgaggattgttggacagtgggtgcaggacagtgggtgcagtgcactgagcatgagccaaagcagggcgaggcatctcctcatctgggaagtgcaaggggtcagggaattccttttactaaccaaggaaagggtgacagatggcacctggaaaatctggtcacttccaccctaatactgtgcttttccgatggtcttagcaaatggcacaccaggaggttatatcccacacctggctcagaaggtcctacacccacggagtctcgctcattgctagcaaagcagtctgagatcaaactgcaaggtggcagcgaggctgggggaggggctcccacaattgccttttgtttggctatgccctgaccccagaggtggactctacagaggcaggcaggcctccttgagctgtggtgggctccacccagttcgaacttcccagccactttgtttactcaaaaccgctcaactatatggaaactgaacaacctgctcctgaatgactactgggtacataacaaagtgaaggcagaaataaagatgttctttgaaaccaatgagaacaaagacacaacataccagaatctctgggacacattcaaagcagtgtgtagagggaaatttgtagcactatataccctcaaaagaaagcaggaaagatctaaaactgacaacctaacatcataattaaaagaactagagaagcaagagcaaacacattcaaaagctagcagaaggcaaaaataactaagatcagaatggagctgaaggagatagagacacaaaaaacccttcaaaaaatcaatgaatccaggaactggttttatgaaagaatcaacaaaattaggagactgctagcaagactaataaagaagaaaagggagaagaatcaaatagatacaataaaaaatgataaaggggatatcaccaccgatcccacagaaatacaaactgccatcagagaatactataaacacctctatgcaaataaactagaaaatctggaagaaatagataaattcctcgacacaaacactctcccaagactaaaccaggaagaagttgaatgtcttaataggccaataagaggctctgaaattgaggcaataattaatagcttaccaaccaaaaaaagtccaggatcagacggattcacagcaaggacttcatgtctaaaacaccaaaagcaatggcaacaaaagccaaaattgacaaatgggatcttattaaactaaagagcttctgcacagcaaaagaaactaccgtcggagtgaacaggcaacctacagaatgggagaaaatttttgcattctacttatctgacaaagggctaatatccagaatctacaatgaactcaaacaaatttacaagaaaaaaacaaccccatcaaaaagtgggcgaaggatatgaacagacacttctcaaaagaagacatttatgcagccaacagacacatgaaaaaatgctcatcatcactggccatcagagaaatgcaaatcaaaaccacaatgagataccatctcacaccagttagaatggcaatcattaaaaattcaggaaacaacaggtgctgaagagggtgtggagaaataggaacacttttacactgttggtgggactgtaaactagttcaaccattgtggaagtcagtgtggtgattcctcagggttctagaactaggaataccatttgacccagccatcccattactgggtatatacccaaagaactttgaaacatgctgctataaagacacatgcacatgtctgtttatagtggcactattcacaatagcaaagacttggaaccaacccaaatgtccaataatgatagattggattaagaaaatgtgtcacatatacaccatggaatactatgcagccataaaaaatgatgagttcctgtcctttgtagggacatggatgaagctggaaaccatcattctcagcaagctatcacaaggaaaaaaaaccaaacaccgcatgttctcactcataggtgggaatagaacaatgagaacacatggatacaggaaggggaacatcacacactggggcctgttgtggggtgggggcagtggggagggatagcattaggagatatacctaatgttaaatgatgagttaatgggtgcagcacactaacatgacacatgtatacatatgtaacaaacctgcacattgtgtacatgtaccctaaaacttcaagaataaaaaaaaaagagtttttcaggatgatggtccatcctgaagtacataggaaaaaaaaaaaaaaggaaaccactatggtattccaagttcatacaatgtagaatagaagctggagtgttagtacagaaagcattatctgttcgatagcccggataaacaacttcaggaaagtttcaggatgcaaaatcaatgtgcaagaatcactagcagtcctatataccaacaaaatccaagtcaagagccaaatcaggaacacaatcccattcacaactgccacaaaaaataaaataaaatgtctagaaatacagtttaccagggatgtaaaatatctttacaaggatcactacaaaccactgctcaagaaatcagagatgatacaaacaaatggaaaaaaaatccatgctcatgggtaggaagaatcagtatcattaaaatggttatactgcccaaagcaatttgtagatttcatgctattcttatcaaactgtcaatgacatttttcaaagaattagaaaaatgtattttaaaattcatatggaaccaaaaataaaaagcccaaatagccaaggcaattgtaagcaaaaagaatgaagctggaggtatcatattacctgatttcaaactatgctacagggccacagtaaccaaaacagcatgatactagtataaaaacagatacgtggatcaatgggacagaatagagaactcagaaataaggtcgcatacctacaactgtctgatctttaacaaagctgacaaaaaaaatggggaaaggacaccctatttaataaatggtgttgggataactggctagccctacgcagaagattgaaactggaccccttccttacacaatatacaaaaattaactcaagatggactaaagacttaaatgtaaaactcaacactataaaaaccgtggaagacaacctaggcaataccattttgtgcataggaacttgtaaagatttcatgataaaaacaccaaaagcaactgcaacaaaagaaaataaaaatgacaaacagtatctaagtaaacttaagagtttctgcatagcaaaataaaatattaacagagtaaacaaacatactaaagaatgggagaaaatttttgcaaactatgcatctgacaaaggtctaatatctagcatctacaaggaactaaaacacattttcaagaaaaaaaacattaaaaagtgagcaaaggtcatgaacagacacttttcaaaggaagtcatacatgcaaccaacaatcacatgaaaaaaagctcaacataactgatcattagatgtagatgatgggttgatgggtgcagcaaaccatcacagcacgtatatacctacgtaacaaaccggcatgttcttcacatgtgtcccagaacttgaagtataataaaaaagttaattaattaaaaaaagaaaaatgtaaatcaaaaccacaatgagataccatctcacaccagagtggctgttcttaaaaagtcaaaaaattaccgatgttgatgaagtcgtggaggaaaggaaacacttgtacactctaagagtgtaaattagttcaatcaagaccagactaaatatagatatgcatccagaaatgcttttagaaaatatatcatatgtttataatacataagctaataaaatgggagagttctctgattcccctggcaggatgtgtgacaggggtgtggctcacctgtttggtcacccggcagctcaaacccctaaggcagatgggcaggtgcagaggccaggcaggtgcagaggccagggcagagcgttttggactctcagccccatggcagcgtctagggctgggtgcctacaaccacagtgttactaagctctgtcagctttgccatctgcaggcggcttgtgtgttagttagcccaataaaccctctgccttatctcaagggcagaaggccagtgtgacagtcttatgtatcctgagttcttgcccagtgtcccaaaagaatcggatcacacgtgagcgtgaaggattgaatgcaaggttttgttgttgttgttgttgttttctttcgttttgtttttgttttttagagacggagcctcactctgtagcccaagctggagtgcagtggcgccgtcttggctcactgcaaccttcacctctggggctcaagagtgaatgcaaggttttattgagtggtgcaggtggctctcagcgagatggataggtagcagaaggagggatagactgggaaggtggtcttcccctgcagtcgggctgcccagaggcaggactctgctctgaccgccgccagctccccaccaccccacctctccgctgaactatcctaagcatctagagaggtccctcctcttctctatttctctgccacatcgttctgccgttgctagtctgcttgtcggctggtcgtctggccttgatgttcagctgcttgtgtgtgtgcctgctaaggtctcaggtttatgtgggcacagaatggggggcgtggtaagccagagaggtcttggaaaatgcaacattcaggctcaaaaacaggagtgcctgttctcaattaggtctgtgggcacatgcccgagggtgaatccctcaccagtgaccttgctcttctctaccccacacttcgctgcccaatctccagttccactaatatatctaaaagtcacatgggatccctccagtctagattattggtgagactactgaaagcttcaggtacaactttaacatctgcttaccttgtttttttttctcttaaacagctttagtaatgtataattgatgtactataaattctacctatttaaagtgtacagttgataagttttgacatgtaaacattcatgaaaccattactacaatcaagataataatagatcaattgccgcaacagttttatcatgttcctttgtaattgtcttatacttctccccagtctcctatagccaggtaaccattcatctgttttctgttaatagagctttgcttgcatgttatagagtttcatataaatggaaccacagtctgtatacttgtttcactagcatctttcactcagcatcattatttttattttgagatttatttactcttcatgtaccaatggttcattccttcatagtgcggagaaatacctcattgtatagatatgctacaatttttttattcattctctgttgatggacatttaaattgtttccaatttgaggtcattgcaaataaaattacgatgaacatttgtgtaaaatctttaaatggatatgtgttttcatttctcttggctaaatacctagaagtaaattggctagatcacagggtaagtggatgtttaactttttaggaaactatcaaactgttttccaaactgattttaccattttatttccaccagcagcgatggagagttctggttgctttatattcttgccaacatttgatatgacctgtctctttaatttcagcctttctaatatgtgcatagtacttcattctggttttagattgcctttccctaataactaataataataagcatcttttcatgtatttactgaccatctgtatcttctttggtgacatgtcttatccaacattttaattactttgttttattatttatcgagttttaagagttatttatatgtgttctatgtatcttttagcagatatatgttttgtaaaatattttttatttcaatagctttcggggtacaagtggtttttggttatatgtattaattgtatattagttaattctgagattttattgcaaccatcacccaagtagtgcatgttgaacccaataggtagtatttatcccacaccccattcctaccctctcctttctgagtctctaaagcccattatattactttatatacctttccgtactcacagcttagctctcacttacaagcgagaacatacgttgtttggctttccattcctgagtgatttcacttggaataatggcctccagctccatttaagttgccgcaaaagacattattttgttccttctcatggctgagtagtatttaatgatttatatatacacctcattttatttatctactctttggtcagtgtagacttaggttagttccatatctttacaattgttaattggattgcaataaacatatgtgtgcatgttttttttttcttcatataatgactctttttttggtggggggatagatacacagtaatggcattgctgtattgaatggtagatctacttttcatttctttttttttgagatggagttttgttcttattgcccaggctgaggtgcagtggcgtgatctcggatcactgcaacctccgcctcccagattcaaaagattctcctgcctcagcctcccaagtagctgggattgtaggtgcccacctccatgctcagctaattttttgtactctttttagtagagatagagtttcactatgttaaccaggctggtctcaaacgcctgagctcgtgatccacttgcctcagcctcccaatgttctgggattacaggtgtgagccaccgtgcctggcctcaacagtgttttatagttctccttgtacggacattttatcttcctggttaagtatgttcttaggtattatatttttttgcagttaaaaaagtgatggaatttttaaatttgattctcagcttggatgttattgctgtataactgtgctactgatttgtgtatattgattttgtaacctgagatgtaactaaatttgtttatcaaatctaggagtcttttgaagaaatctttagagttttctaggtatacaatcatatcataagtgaacagtgatagtttgacttcatctttttcaacttggatgtctttcatttcttttttttcccctgattgctctgactaggacttccagttctatattgaatagaagtgataaaagtgggcatccttgtcttgttccagttctcagagggaatttcagcatttccccattgagtataatgttggctgtgagtttgtcctatatggcttttattactttgaggtaagtcccttctatgcctaatttgttgaaggtatttattataaagcattgctgcatattatcaaatactttttctgcatccattgagatgattatgtggcttttgtttttaaatctgtttatgtgatgtattccatttattgacttgcatatgttaaaacatccctgtatccctgggatgaaactcacttgaccaggatgtattatctttttgaggtgctattggagtcagttagctagtattttgttgagaatttttgcatctctgttcatcagggatattagtctgtagatttttttgttttttgttatgtcatttattagtctgtagttttgttgttgttgttatatcattttctagatactggcttcacagaatgatttaggaagaattccctctttctttatttttgggaatcatttcagtgggaataattgatactaattattctctgagtgtgtggtataattcagctctgaattcttctggacctgtatattttgttgttggtggtaatttctttaatttctaattcaatcccactgttactggtctgttcagggtttctacttcttcctgatttaatctagaagggttttatgcttccaggaatttatctatttcctctaaattttttagttgtgtgtgtaacagtgatcatagtagccttgaataattttttggatttctctggtattggttgtaatacctcctgcttcattcctaattaagcttgtttggatattctctcttattttcttggttaatctcactaatggtctattaattttgtttatcttttcaaaaaaccagctttttatttcatttcacttaccttttgtattttttgttgtaatttcatttagttctgctctgatccttcctatttctttctttctgatggctttgggtttagtttgttcttgtttctagtgtttcttgagttgtgacaatatagattgtcaatttgtgctctttcagcctttttgatgtaggcatttaatgctatgaaccttagtcttagcactacttttgctgtttcccagaaattttgatcactctgtcactattatcattcattttaaataatttattaatttccatcttgatttttacccaaaaatcattgaagagcaaattacttagttttcatgtatttatatagctttgagggttctttttggagttgatttccagttttacttcactatggtctaagaagatacttgatatgattttgattttcctgattttacagagaacaattttactgatttatttatcagatctaacaatttttaaatgaaatccttgggtttttctagatattatactatgtcaaatgcaatgaagaataacttgacttatttatttccaatttgaatgcactttattttattattattattttttgctcctaattgcactaacaacatcttctggtattatgttatataagaggactgacagtgggcatctttctcttgttccagtccctaggaaacattctttaatttttttcttgttcagtatgattttagtcatggatcatatatggcctttatcattttggagaatgtttcctctaaagtcattttgatggtttggtgatctaaaaccattataatttattatatagggatttggatttttatgggctttttttagcatgtactgaaataatcctataattcttggatctgttaatacggtgggtcatgtttactgatttgcatgtattgaaacatccttccctcctcccttgcacgaattctgtgttaccctagaaaattatcttcttaatgtattattagtttggtttgcttgtattttttgaggacttttgcatctacacttgtattagtccattttgacactgctaataaagacatacctgagactgggaagaaaaagcggtttaattggacttagagttccacatggctggggaggcctcagaatcataacggaaggtgaaaggcatttcttacatagtggcggcaagagaaaatgatgaagacgtacgagcggaaatctctgataaaatcatcagagctcatgagacttattcaataccacaggaatggtatgggtgaaactgccccgtgattcaaattaactctcaccacgtccctcccacaaaaatgtggaacttttgggagtacaattcaagacgagatttgggtggggacacagagccaaaccgtataattctacccctggcccctccaaatctcatgtcctcacatttcaaaacctatcatgccttccccaatattcctcaaagtcttaaatcatttcagcattaacccaaaagtccacagttcaaagtcttatctgaggcaagacaagtcccttccacatatgagcctgtaaaatcaaaagcaagctagttacttcctagatacaatggggttactgatattgggtaaatatagccattccaaatgggagaaattggccaaaataaaggggttacaggacccattcaagtccaaaatccaccagggcagtaaaaatttaaagttccaaaatgatatcctttgactccaggtctcatatccaggtcatgctgatgcaagaggaggattccaatggtcttgggcagttcagtccctgtggccttgcagggtacagcctccaccctggctgctttcatgggctggcaatgagtgtctatggcttttccagttgcatggtccaagatgtttgtgcatgtatcattctggggtctggaggatggtggccttcttcttgctgctccaataagcagtgccctggtggggactctctgtgggggctcacagcacacattttcctttcacactgccttagcagagtttttccatgatggtctcacccctgtagcaaacttctgcctggacattcaggagtttccgtacatcttctaaaatcaaggtggaggttcccaaaccccaatttttgacatccatgtactgcaggctccataccatgtggaagctgccaaggtttgaggcttccaccctctgaagccatggtctgagttctacattggcccatttcagccacggctggagtggctgagatgaaaggcaccaagtctctagactgcacacagcatgtggaccctgagccctgcctaggaaaccatttttttctcctagacctctgggtctgtgatgggagaggctgctgcaaaggtctctgacattcctggaagacattttccccattgtcttgaggattaacattcagcttttcattactaatgcaaatacatgcagccagtttgaatttctcctcagaaaataagattttcttttctattgcattattaggctgcaaattttccaaacttttatgctctgctttcctttcaaaaaggaatgcatttaacagcacccaagtcacctcttgaatgctttgctgcttagaaatttcttctgtcagataccctaaatcatctctctcaagttcaaagtttcacaaatctctagcccggggcaaaatgccacccgtctctttactaaaacataacaagaatcacctctgctctagttcctaacaagttcctcatctctatctaagacaacctgagcctggatttcattgtccataccatttccaatacttttgtcaaagtcattcaacaagtctctatgaaattccaaactttctctcatttttctgtcttcttctgagccctccaaactgttccaatctttgcctattacccagttccaaagtcgcttctacatttttgggtatcttttcagcaatgccccaccctactagtaccaatttactctatttttctgttttcacactgttgataaagacaaaccagatactgtgaagaaaaagaggcttggccaggcgtggtgactcacacctgtaatcccagcactttgggaggccaagacgtgcagatcatgaggtcaggagattgaaaccatcctggctaacacggtgaaaccccatctctactcaaaatacaaaaaattagccagacgccttggtgggcacctgtagtcccagctactcgggaggctgaggcaggagaatgccatgaacccggggggcagagtttgcagtgagccgtgatcgcgccactgcactccaacctgggggacagagcgagactctgtctcaaaaaaaaaaaaaaaagaaaagaaagaaaaggaggcttaattagacttaaagttcctcatggctggggaggcctcagaatcagagcaggaggtgaatggcacttcttacatggtagcagcaacagaaaatgtggaagatgcaaaagtggaaaccccagataaaaccatcagatctcatgagactcattcactataatgagaacagtatggaagaaacagtccccgtgattcaaattaactcccatagggtccctcacacaacacatggaaattatgggagtacaattcaagatgatatttgggtggggacacagagccaaaccatatcaatactcatcagtgatactggcttgtagttttattgttttgttatgcccatgctttgtttttgtgtaagagtaacattatcctcatagaatgagtttgaattattcccttttttttttatttctctttttcttttcttttttttttttgaaaaggttgagtcagattggtatcaagctgttacatgttgggtataattcaaaagtgggatcataagtttctgaacctttttattttgatgaaagacattttattacttcaataacagcttcaatcccttgcccattattatttgtttgatgttttcaaccgctttatagttcaatcttagtaagttttgagtccagaaattcatatatttcttctaggtttactattaatttatcataacaattctaatagttttgtattattttggtctcagtttttatgtctcttctttttccatttctgatggtttttatttgcatcttgtctatgtttttcttgcttaacttagctaaaggtttgttaacatcattgatctttgaaacaagtcagggtcactggtctggttgtctaaggtgttatcagagcttgtgatctcaggaccaaaaaaattaagaagcgtggttacaaagggtgaggttggagcaaaaatttaataacaaaaaaacaaagctctcggcagtggagagggttccctgatggttgctgtgttacggttgtattcaaaagctcttatgaggaactgctttcatctctgtaactgagtaacttttcttatctataaaactgcctgcatagtttcatctctgtaactgagtaacttttcttatctataaaaccgcctgcatatctcccagttattctctgtcattgtggatatgtctccaggaaagcacaaagtgctgtttcttgcgtttgtataatgatgggtttgttttaggtacacccccctcctctctttgcaaattcccatggagcccactgtgtacatgtctgaaaaggggaggacactttttcctgggagcttactaatcatacaaagagcaaagggtttctatgctggacattgcatgccttgcctgcttatctgtggcttatctgtgcaggtgcactgtagctgtgattttttttttaggcaggcagcttctgcagtctgagtttttccccaagctgctctatttttcctgtagttgtgagttttcaggaaggcagcatttttgaggaccagccttaattgtttacttaactgattttctcttttcttctccatcatcttcacaaaaaaacaactttttgtttcatagatcttttgtattgtgtttattttagcctcaaatttatttaactgtgttctggtctttataatttctttctttctattagctttgggtttggtttgttcctgcttttttagttctttgatgtataggattaggttatttgaagtctttcaacttttttgatacagatgtttgttacaagaaactttcttcttacagtttttttggccatcttccatagatgttggtatgctgtacttccattttcatttgtctcacaaaatttttaaattttcttcttaataacttcattgacatgtttgtcatttagcagtatgtttaatttccatgtgttcatgtctgttttccagattcttcttttaatttattttttgttttatttcattgtggtcagaaaatatacttcatatgatacttgtgtttttgaatttgtacaggcttgtttggtagcctatcatagaattaagggagacattttttgtgctaataaaaagaatgtctattctacagcaattatgtgaaactttctgtatatgtcagttaggcccttcatatctagtgtgtactttaactctgatgtttctgtgttgattttcttcctggataatctttccattacagagaatggggtgttaaagtctcctactattgctgtgttgcatgctagttttgcctttaggtctgttaatgtttgctttacatgcttgagagctcaggttttggtaagtataatgactaaatcttgctaaactgaccccttcattatcatgtagttactgtctttgttttttgttttttttttcccgtctgatttgtaatctgtttataactacacctgtacttttctggtttctagttgcatggaatatattttgccatcccttcactttcagtctatgtatggctttataagtgaagtgggtttctttaaggcagcatgattctttattcagccattctatgtcttttaactgagaactgagacaatttacatccatttttattattgacaagtaaggcttactagagccattttgttgattgtttactgtttgtttttagactcctctcttccttccttcctgtctttcttcataattaggtgattgtctctggtagtatatttcaagttgctgctttttaagtacatcaatgatagatttcttaactgtggttaccagtagacttacagaaaaccattttagagatatggcatgttattttaaagagatcacaacttagattgcaaataaaattataaaataaataagggcaaaagtcacagaaaatgtatatactttaactcaatcacctacccattttgactcatagttatcttgatttacatatttgtatatcatctgtttcttaaccggttgctatagttgttatgttttctgggataggtgaaatgcagaacacaaattcagtactagcttattctgggtttttgcatgtactcaattttaccacttgtttttataccttgaaaagttactttttgcatgatagtgttttactctttctgactgaagagctcccattagcattttttgcaagatgggtctggtggtggagtctcaggacttttccttagttcagctaaagatgggatccttgtctgtcccatggccacaaaaatttaggctcacagatggtttgaatgtcgaggactctgaaaggccagagtccccctgctagagtgcttcctgctcaaagcttgaatcccagcttccacacagaaagaggaggggcctggctcttccccactgcaaatggcacaaacttgctgaggttccaccccagtgaacatttttctcagtgttcaagctctttggagattctctggggaccacctcctacctggctgtctctttcccccttgtaaagaagtacatctgaatgctatttgaaagagcataaggaagatcaatctttactgcttcctgctgacaaggggtgctgtttttgggaaatggtggtcagagctcactcacaggcctatctaagagttcccccagcagaaagggccattgtcagagactctgcttgcattattgtttggagtttgatgccctgaaggcaagaacagacaaactaggttattagaaaacatgtatcaaaatgaaacaaggggaggagtaaggatagctcaaaaattctgaggccttttatcactttgcacagggagagaaaggccaaaagccagactggtaaaatacccttttgctggcatgttggtcttctgggttcccttcttctgggcccaatctttagccaaccagcttaaggtttggaaagttaactctttccagtttggaagatgcatctgaggggaatgtcccagaatacggagacataattacctatccgtgaagagagaacagaggagaagaaaggaaaaagaaggcaccttttaaagaagtcccagggggtcatgatgcattcaaaatgggtacagactgaaggtgaatggctactcacctaggaagagggtggcaggtgtccctagttctcttctctttctagcagatacctggggtacatgagggagaaagagcatcctcttttcttcttccgtccttgcttccccgagtgctggtaaccttggtatgtgctgaaacaggtgtcaaagcaacatgcacccatgaaccagtggggcctagggggtgagaacattcactcttacccacttacccacatacaccctatctcccctgctttcagtagtctgggagtccctagacctcatctatgccatggatactaacaaggcttttatccatgaaccagggagcttgggcttcacttaattggcaggaaacagccacactcacctgcactgtgcattttgttgcacaaagtaggggcttatcctgccttagggactgactctttttcaggtttgatatctgcatgttttccttggcctggctcttataaaaccccacccaggaactgggttttctcctgcctgtctgcgtgtgtgttatgtgtaatgtctgcagaaagagctctaaatgattttggcctgaaaaagacaaacacttgcatctaatattttttaaagagaagttaaaaactgtggtaccgttcagttcacgtgactttaatctttgagaaataggaagaggcttaaagattaatggtaaaaagcagatgtcattacagtgtaaataggtggactaaataacgcaatggtgtctttgtccatctcagggccatgaaaatttaggctggcagatggttcaacaggtgagtaaagcagggttttattgggtgaaaaggaaaaaaaaaggggaaacagggatcttccacaaggctggagacccctgccagagtgcttcccactagcagcttgaatcccaggttccacatgggatatttgccgggctcctccctgttgcaaacagtgcaaaattcctgaggttccaccccagtgcacattcctcccagtgcacaggcttgttggagattctctggggacctccttctcctctgactagctcagtggtcaattctatgttttgtttgcctggtaaatacttcatctctcatttatatttgattgataattatttttgtttcaatattttttggtggcatccttttgtgttgagcactttgaaaacatcattccagtccttcctggtctgtatagtttcttttgggaagtctatctccataaatattggcgctgttttatatgttatttgctttcacttgctgatttcaatcttttttctttaatgtatttttttttgtcctttgtgactttgattattttgttaattggggtagtcttatttgggtttgcattgtgttctaagacctttctgtacctggacattttatgtttctcaagttttgaaaagttttttgttactatttttttgaatgagcgttctacccttgctcttactcacatctctcttgaacaccaataattcttagactgggtcttttgaagtaattttctatattttgtaggtggcacttgcttttttattctctcttgactttttaaaaataaaataacgagtcttagagctcacagattcttttctgggcttggatcattctgtggtttaagacctctaatggattttgaattcagcaaatgcatttcttagttccaagatttctgattgatttctttgtattattttaacctttttgttaaatttctcggataaatttctgaaataacttcctgtgttaacttagacattactaagttttcttaaaactgctattttgtattctgggtcagagagctcagaaattgggttatcttattagtgtcaatcactagatttttgcattgtccttttggagaggtcctggttccctgttctctgttgtttcttgtgaatatatgcatgcctttgcattgaaggattatttgttccattttttttctgtctttttttaatggaatatatttgcttagaaaatctttaccgaaaagtcactgcattcactttagttctaggtgacatgttaagcccaggtttacctcagctcatgtgaatgattagagctctgcctgtcccaagtgatgggggttccaaatggattatcctggaagtgtgagaacactgcctaagggcttgttcccagtatacctaaagaacttacatcctacagcatgctgttgctaagcaactactctgatttgaggtcaatttttggctgagttacggagaagagtttccatgtctaagaggttggtagtcctgcctctcttttttgtctctgcctgtcctcaggaatgtttctcccttcatgcactcataacatttccactgggttaaggaaagacaggtctaccagggaacttgataagatggggaagcttagtgaccatatcagtttgtctttctctcatttatataaaaattacttgacattgagtaatttataaagtaaagaggcttaattgcctcacattctgtatgctatacaggaagcatagtggcttctacctctcaggaggcctcaggaagcttgcaatcatagtggaaggcaaaagggcagtcaacacctcatatggccagagcaagaggaagggagttgtaggaggtgctacacacttttaaacaaacagatctcttgagaatgctgttacaagaacagcaccaaagggatagtgctgaatcattcatgaaagatccacctgatgatccaatcacctcccagaaaacccatctccaacactggtgattacaactgaaaatgagatttgggtggggacacagatccaaatcatattgtaaatcatgaattggagatagatattctgcgtttttggtgcagagcagagttgcaagttaggggcattattaatgtagacatagacatataattcccctacgtagtgtctactcagactttttctacttttatgacactgggaaatgtgttatcctcttaattaagcttttggttgttgtggtgtagatctcagtgccatatgtttgttttgttttgttttgcatgaagaaaaaaaggctgcttgtctctactctgccattttggaaccagaagtctcttgctccgtatattcttaataaacgtttcttatcagatatatgaattagaactttttaaattctacttatcatcagtacacttttttgatggtgtcctttcaagaacaaacatattcatttataagaatatcagtttatccattttaacttagttttttgtgactttgttgccttgtcctagaaaccattgccaaattgaagatagaaaagatttactttttctattctgggttttgtacttctgtttgttaactttgggttgttgatgtattttaaattagttctttatgtgttgtcagagaaagtgtatcttgtttttttggcctttggataatcagtctcccagaagtatttgtggaaaatattgttgttttcctattcaatagtttgacgtctttctcaaaaattaagtcaccactgtgtaaaaggatttctggattctaaaatctgttccatttatttatatggtgatctgtgttcctgtgtcacactcttataactattgatgatatgttgttggttgaaaatcggaaatgcaaggactaaattatttttcaaaatattactggttattgagattgtgccactgcactccagcctggccacagagcaagactctgtctcaaaaaaattatacatatatatatatatatatatatatatatatatatattgtgtgtgtgtatatatatatagtgtgtatatatatagtgtgtatatatatagtatatatacacacacacacgtatgtgtatgtgtgtatatatatatatatatctcgctattttttggtctcctgtatatctatattaatttagaatgagcatgtttatttctgtaaagaacccagctgggaatttaatatggattttggttaatttgtttattaattaagattttcaattgaggaatatgagattttatttattcattaagaattttattcctcaatatttagtaacttttacaatttaagttttaagtttcgcaatttattttatttttttgagatggagtctcattctgtcacccaggttggagtataatggtgccatctcagctcactacaacctccacctcccaggttcaagtgattctcctgcttcagcctcccaagtagctgggattacaggctcacgccaccacgcctggctaattttttatatctttagtagagctggggcttcaccatgttggccaggctggtctcgaacttctgacctcatggtctgcccgcctcggcctcccaaagtgctgggactacaggcatgagccactgcacctggcctaagttttgcaattcttttaatgtttttcctgtttttttaaaataatttttgattatattttatgtaggatttttgaacatgttattttcttctgtattgttcaattatgtaacaatacaattaatatttgaaggttgaccgttagtcctaaaaatgtgcttattttgttgttgatctaatattttctaggaaagtctaagatattctttacataaggtcatgccttttgtcaacaaagagagtgtacttatttcttaccttctaataaggattatttttgttttgtgttacttcctatttgctttggctggaatctccaatataatgttgaatagaagtaataagaatgaatgtctagtcttttccttattttagaaaaaaatgagttaatcttcataataggtgtctccagacaaaaagagccatgtatgaatacacacacattagtacacacctatgagggaggattttattgtaggaatttgcttaggctgagaaatattatgatatacacttacacactttatatttaggaaagctgatgctgtaattcaatctgagactgaaggccttagaactaggagaaatagttgtgtaattatttgtctgaggatgatggccttagaacttaaggagctacaagtggggtttactagtgcaaaccctagtgtccaatggcccaatatccagaagcctcaaataaagaaggcagaataatattaatgtcccagccaaagaaaagagaaatatttgtcttcttctgccttttgctctatttgggttcttaacggattggatgatacctgcccacaatcatgagagatatctttagtcagtctactgatttaaatactaatctctttttaaagtattgtaacgtttgtcacagaatcataaaaatatctatcctaaaattcatacaaaccccaaaatagccaaataaatcataaactaaaagaagaaagccagaggcatcaaattacctaatttcaaaggatattaaaagcctgtagtaactaaaacagcatggtagtagtacaaaaacagagacatagagcaatggaacagaatagagaaccaaataataaagccacacacctactgccacctgatttttaatgaagtcaggaataacaagcaatgaagaaagaaccctctattcaataaatgatgctgtgataattgtatagtcatatgcagaagactgaaatttgacctcttcctttcaccacatacagatatcaactcaaggtgtattaaatacttaaatgtaaaatctaagactatataaatatgagaagaaaacctcagaaataccatcctggatacaagccctggccaaagttttatgacaattaccccaaaaggaaattgtaacaaaaaaaaaattgacaagtgagacctaattaaactaaagaacttgtgcacagaaaaacattcaataacataaacagataacctacagaataggagaaaacatttcaatactatgcatccaacaaaggactaatgtttagaatctagaaggaacttaaacaaattaacaagcaaaaaagaaaaatcccactaaagagtggccaaaagagaacagacacttctcaagaataagtacacatggccaacaagcatatgaaaaaatactcaacattactaatcatcagagaaaagaaaatcataaaaaccactataagataccatcccccctagtcagaatgaatatcattaaaaagcacaaaatgacaggtgttggcaagattagggagaaaagaggatgctcatacactgttcgtgggaatgtaaattagttcagccactgtagaaagcagtttgaagatttttcaaataacctaaaatagaattaccattttacccatcaatcgcattactgggtatatacccaaaggactgtaagttgttctaccagaaagacacatgcacacctacgtttatcaacagcatcacagtactattcataatagcaaaaacatggaatcaatctatatgcccaacaatggtggcctggataaagaaaatatggtacacatataaatgatggaatactatgcagcaatgaaaaaaaaacaaaatcatgtctcttgagcaacacagatgcagctggaattcattaccctaggcaaattaccaccagaaaggaaaaccaaataccacatattctcagttgtaagtgggaactaaacattgagtacctatggacaaagagaaaggaataataggcaatgggaaatatgtgaaagtgtagaatgagagatctatgagaatcaaaaaactacctaccaggtactgtattaactatcttggtgatgaaataatttttacacaaaaaccctgtgacatgaaatttactcatgaagaagttgacactttaaccttctgaacctaaagtaaaatttagaggaggaaaaatgaaatgctctcacagataaatccagaaataattttttttttttttagctatttggtaatctcttaaaccagtcaagttgacacataaaattaaccatcatagttgtgcaattattttttgtggcatttatattgtgcaatatattttatggcattttcagtgcaattgtattattttatattggataattagaattatgtaaatatattgatttttatatatcaatcttttatcctgacaaggttatttatttgtttttgatctaatattttatactagatttattaagatattctctatgtaaagttgtatcatgtactgacatatgtaattgtattaacttctttttcaatatgcatgtttcttattttctgtcattgtctaattgccttagcttaaatatacaatggaatattgtcctaaaatgataaatagatctcttcatcttgttttttatcttaggtagtatttcactgatacacataataatagttttagacttttcatagctgtcttttatcagtttcatgacatttaacatcattctggttttattgaatatttttattttttattttaagtctatttctattttcagtttctgtcaattgcatatcatagttagtgtcttttgagagatttgctcattttattgagttatatgatttgttggtatgcatttgctcctagcaatgtactgtaatattttgtatttctgtatagtgtgtagtaatgtgtagtctttcatatctgattttaataatgggagtcttctcttttatgagaggtaagtctacataaatactctttgttttatttaattttgttaatcttttgaatgtaccaaattttggttttatttcctttgttgtttttattctttcatttgcttattttagcaataatcactatttcttttcttctgctttggggggtttgttcattttttctagttccttaaagtataaaattgcatattaattaaaaatttttgtctaattaatgtaggcattttaaggtcataaattgtcctctaaatattgctttttaataaattttggtgtatttgtttttaatattcttaaactttgttctgttttcttttgattttatctttgttattttgaattatgttgtttaatgtgtaatcatttgtgaatttctcaattttttaaaactgctgacattgaaggttattcctttgtattttcagaaaataacacatactatttcaatcctcttaaacttattgaggcttttccggtcaagtgatgatttgttttggaaatattaatatgcacttgataatattaaatatgtagctgctttttggagtgtgttatagttgtgtgttagagctagaagatttatagtgttcttctagtattctatttccttgttgatctttttttaaatttttgtgtatttttaagagtgaaatagagggggtgggccaagatggctgattagaagcagcagtggtccatggctctcatggagaagaatgaaaacagtgaataaattctgcaacttcaactgaggaattaaggttctcaaattgggactgacttagcagttggcacaactcagagagtgagaaaaagcggagtgggatgacagcccaccccagagtgccacaagccaggggagtccctacccccagccaaaggaggtatctctactggtgatacctccaggtgtgtgagagaccgaggctgttgctgtcagttgctatgggattgggtgaagggggatgaatggagaaatgaagacaaagacaaaaagatctgttttaaaagaaggtgtcaggggctccttgcttctagtgaacaaaggctttgagcttctacagcccttcatatttattaggtgaaaagagcagggaggaagaggtaatggttggtcagctgcttgatttatcacaggtacacataatttctttctttgtacaacaggcttcagatattcctacagataatcacaaggaacactgtgcttggggtgtgattgccctcagcactccttctgggggcagacatagtcatcagttttccaacatcctgctttcatgagaacagttttctgtttgctcatatagcctccagtggtatgctgagttggtcacgaccctcattcttttggcctgtaacatctccctctttttgttttttcattaattgaataaaggtaattgcaggttctgcagctctcaattgccatttggtggtccacctgattttgaagactatgaacaaaaaacagaaacataataacattaatccaatagtaacaacaaagacattgagttgctgtttgcggtaggtccaagggttaaggctctctaaaccttgttggaattctgcccaagcttttaaacagggctgaaacacttgagtttgcttatcgaagttaaggattttactttgtaaatcattaatatcaaaagtaacattggatgtgaaagctccctgtaaatgggcctttacaaggctccaggaatattcactttggttatattccaaattggtcacacaaatatgagtatgattaaaatgacaatgcaattgctgatgcaactgcaaactttgttatttgttctcctagccaaagaacagtagcctttaacattgccacctctgttcatatttcagcgttaattttattttgaagcatccatgcctggccagctgtgcgtgtccaattttctacatattgagctgtttgaatagagcgatgcattgctactgaggacatcacaacagaggttatcaatgtaactaaggagactatagcaacaattatcatgcctaaggctctacgagcacgatgagtaagctgagtaaaaaagagttttataagatgtaaaatgggggtggccacccaaggttcagacagatttacaggaatccataatctgggaatgcaacctagaattattagggtggatatatcatgtgtctgtattgtgctttgattaaggcaatgataaagttgacaggaatcacaagtcgactgggcatcatccacctggagttggtccttttttgctactaagaaaacgtaagaattaaagcacaaattataaattgagtggtaatattttctaccatgatcatattaaaactgcatttagcactgttattattattgaataatgtcccaactcaaatgctgccattaataaatgggagtgctgttttgcatatcgaattctggattggacctctctttccttgagaatgccattgaggcaaaggtgggctaaggcctgcgccatgccaagtaatttgcgcagcagattcggattgaatcccaatgtgacgtggcaaagagatgttaaagttttgccaccagtggcagtgaagttcatgccatgaggtctgatgctcatctctcccaaccaagtgaccatggggaccccagtcaataatgtctcccatcagcatggactgttgtctagctagggagccaagacactgggtccaaggaggggagttagaattatcaaagggaacccattctgtataattaatacaatttgggcgatgagaccaggagtgattagtaactgcactagaaatattaatagagctgaggcccaataggcacaaatattttcttttttttactattatactttacgttctagggtacatttgcacaacgtgcaggtttgttacatatgtatacatgtgccatgttggtgagctgcacccattaactcatcatttacattaggtatatctcctaatgctttccttcccccctccccccaccccatgacaggccccagtgtgtgatgttccccttcctgtgtccaagtgttctcattgttcaattcccacctatgagtgagaacatgaggtgtctggttttttgtccttgcgacagtttgctgagaatgatggtttccagcctcatccatgtccttataaaagacatgaactcatccctttttatggctgcatagtattccatggtgtatatgtgccacattttcttaatccagtctatcattgatggacatttggggtggttccaagtctttgctatcgtgaatagtgttgcaataaacatacgtgtgcatgtgaggaaagacaattttgaaaccaaagtttgattttggaaagcctttttagtatatttaaagcatttgatattgtaaaacagaattccaaattactataagtcatttattttgccaaaatgatgactcagaaacgttaaagaagcaaaaaccttttataactcttttgaatttagttaatatattcacatagataacctattctgcaagattaattttcagaatttttctaccacttgtttgaaacttcagctttttcctaatttgaaaagccaggtgtcaggaaagacaattttttaaattatactttaaattctagggtacatgtgcacaatgtgcaggtttgttacatttgtatacatggttgcgtggcacatatattttctatggtaactcaatcatgcctgggattaaattgcaaggaaactgcagttgagtgatgtatcctgggtgatgcataaaggaagtccctccaatggagcagtataattgataccattgtcctgagagtctaattgctctgtgtcagggggagttaagggtcctggtgcccatactccttgatcatgatataactcaggaggattgccagtccagagtaccggtcatactactgggaggttaagaacatatgcccaatatgtttttgcctctgcacagggaaaacatactgcacaggatattacagctgacatggccataaacttggagttaggggtttttgcctcaccctgatgctctagcagtttctcagctttttgtgtggttttcttgatctgtccccatgtctttgcattcagattcaactggctcatggctcatattggaggagctgggcccatggttgggatccatgggtccctccagtctcccattccatggtcacatacatggtgggggaacccacacagtttgtccatgtcctgtaaaaacataagcataccctcatccccacgttagtaaatctactgggcctttccattgcccttcttctggggacttctataatacctttaggtaaacttttttccctttaacatttgccactgtcattctgccggagtcttattatctgtaacaggagctaaaaaatttaaagtaaataaggctaaatgtaattttatttgaggtggtagctggtctcctactccccctttttgtttttttcaacatacactgtatgttagttacatcaattacattaataaatgtaatgcatgtttgatgtgccagctctataatgccttgtcctcagggattgtaaggaattcctgtcttatgagtaatttcccataactataaaaaattttgaaaagcatgactaacataagcaggtccattgtcagattttattggtttaggaacacccatatgggcgaatgacaataaacaatgccgctgtacatggccagctctttctgtttgacacgtagcatgtaacatatgagagtaagtgtctacagtcacatgaacacagctaagcttgccaaaggctgctatatgtgtaatacccatttgccagatttcatttggagctaagcctcgtgggttacatccttttatgggtatatcaccagggacatactggcaagtgggacaggcttgcacaatagctcgagcctggctacgaggcagatgaaacatacaagtaagggtgaggtgttttgatgcaataatgtatgaaaggcttgagcttgctgaaacacagagtcaatcaatttatctgctttgtcattgcctacagatagtggtccaggaagttgtgcgtgagagtgaatatgagaaatatgtaaaggagcagcataagaatgaataacttgctgaagtcttagaaacaagttaaacagctctggttctagggtgcttttaatagtggcagtctcaatgtgactggctacatttacaacataggctgaatcacagacaacgttaataggagttgaagcagtgagctgtaaaacctcaataactgccattaattctgagtgttgagctgaaactccagaggtttttattgtttgagtatgcttaggtccataaatagctgctcagcctttggaagagccatcagtgaaataagtctggccacctggaataggcttgtgataagtaatcacagggaggataaaagggtgaactttacaaaattgcaaaacttgcctgatggatagtggttgtctattattactacaaaatccacaagagcaatttgccaagcagtcaacatttcccatgctgcagcctgttgttggaaatccaagggaacaataattttgtctgggtcatatcctgtaaacatttttgatctatgcctatccatagttataagttgagtaattaaagaaagataaacttgtaaagattttactgtttgattggatagaaaaagccattctattaccattacaaacttgtctataaatgggcccaaaattcctattggagagtagggggttggaagaataaacagaagcaaaggcttttgtggctgtagccaggaggcatgtcttcactgaagcatttgttctacaagctgtaattcagcttctgcctccttagtaagttgccaaggagagtctaatgaagaatctccttggagggtctgataaaggtgtttgagtcgataagtagcaatacctatcatcaggcgcagccaattaatatcccctaacaattgttggaaatctttcagtgtttgtaatctgtccctacggagagttactttctgaagtcgaacacttctttcagtaacaatagtgcttaagtaccgatgtggggaggttgtttgcaccttttctggagctattttgagattccatttaatcaaagcctgttttgtttctctgaataactgatgtaaaatttgatctgtaggagtggccaaaagaatatcctccatataatgaacgatgtaagcagtaggaaacatattccgaggctcctttaatgcctgtcctacaaaatgctgacatagcacaggactgttaagcatgctttgtggtaaaactttccattgataatgagaaccaggttgtctttgatggatagaaagcacagagaaggcaaatcgaggcttatccttctcgtggaagggtatagtacagaaataatctttaagatctattactaagagaggccagtccattaaaatggctgccgcggatgccagaccttgctgtaatgcgcccattggtttaatttgtgcattaatgactcttttggaattgcaaatactggtgaattccagggactaactgactcttcgatatgttctgcatccaattgctcttttactagctgatagagttgagttagtttctcctgtgataggggccattgattcatagaggcatgggtgggacaacagattcttttaaatttttagactcagaacatgactcctgctgtccagcagaataaggagataatggcagacagacagtaagaaacaaactccaagtggagaaatcagaagggtcaactttaagacctttttgatgagctcgttttaatccttctcctattctgttccaaatttccacatcgagagtgcccatctgtggaaaccatgggttatgtacagtgaccttcttcagcatcttagttaatgtttgagaactaacctgagcaccagattgtttaagtaaaactttaagcaactgcacataatgttgctcctgaatagatagattctgccccatgttaccctgattcagaaaacttcccattcccagtacctctttagggcactaaccttatattagctgccagtagacttgtcccaaggtttcttgctcatctggtcagtttcactttctctgctccagcagaccttctttgctcatgtccctgtcctgggcaccacttgtcactgccagttgctacaggattgaatgaagggggatgaatggagaaatgaagacagagacagaaagatctgttttaaaagaaggtgacagggggctccttgtttctagtgaacaagggatctaagcttctacagcccttcgtatttataaggtagaaataggagggagggagaggtaatggttggtcagctgcttgatttatcacaggtacacttaattgctttctttgtacaacaggcttcagatacttctataggtaatcacaaggaacactgtgcttggggtgtgactgccctcagcactctttctgggggcagacacagtcatcagttttccaaatcctgctttcatgagaacagttttctgtttgctccagtggtatactgagttggtcaggaccctcattctttcagcctgtaacagagggtattagagtctggattgaaccgtagcaaacagcagtagccctatagaaggagggcttgactgttaaaagaaaaacaaacaaatagaaagctacagcaacaacatgaacaaaaaaaaaaaaaacgcccataaaaaacccgttcaaaggtcagcaacctcaacaaagttgagaaagaatcaatgcaaaaacgttgaaaatttaaaaagccagagtgcctcttcttgaaatgattgaaacaactctccagcaagggcacctaacttagccaagtctgagatggctgaatttacaaaagtcagcttcagaaggttggtaataacaaactacactgagctaaaggagcatgttataaaacaagacaaagaagctgagaatcataataaaacaatacagggctggacacagtggctaacacctgcaatccaagcaccttgggaggctgaggcagccagatcctgaggtcaggagattgagatgatcctggccaacatggtgaaaggctgtctctactaaaacacaaaaaattaaccaggtgtggtggtgcacacctgtagtctcagctactcagaaggctgaagcaggggaatcacttgaacccatgaggtggacattgcagtgagctgagatcatgccactacactccagcctggtgacagagcaagactccatctcaagaaaaatttacaggagctcaaacccagaattgctcatttaaagaggaacataaatgacccgatgaagctgagaaacacaacatgagaacttcacgacacaataacaagtattgatagccaaataaaccaagcagaggaacgaatctcagagtgtgcagactatttttctgaaataagacaggcagacaaaaatagaggagaaaagaatgaaaaggaatcaacaaaacctctgagaactatggctctatataaaaatacctatgattgattggggtacctgaaagagatagggatagtggaaccaagtttgaaagcatactttgagatataatccaggagaatgtccccaacttagcaatacagggcaacatttgaattcagaaaatccagagaaccccagcaggatgctccatgagaaaatcaacctcaagacacataatcatcagattctccaaggtcacaatgaaagaaaagtgttaagagcagccagagagaaaggccaggtcacctacaaaggaaagcccatcagactaacaacctgtcattggaaaccctacaaaccacaagatatttgggaccaatattcaacattcttaaagaagagaatttgtaacccagaatttcataaccagacacactaagctgtataagtgaaagggaaatcatattcctttcagacaagcaaatgctgaggaaattcatcaccaccaagcttgcctttcaagaactcctgagggaactactaactattgaaaggaaataccgttaccagtgactacaaaaaacacaccaaggtacacagactagtaacactataaaacaaccatgtaaacaagtctgcaaaatagccatcatgatgacaggatgaaattgacacaatattaaccataaatgtaaatggacttaacgcctcaattaaaaacacagaatggcaagctggataaagagtcaagctccatcagtatgttgtcttcaagagacctatttcacatgaaaagacacacataggctcaaaataaagggatggaggaaaatttaccaagcagaggaaaacagaaaaaaagcagtagttacaatttttgttcctgacaaaacagattttaaaccaacaaatattaaaaaaaagacattacatgatgatgagttttcaattcaacaaaaaagctaattattctaaatatatgtgtacccaataaagaagcatccagattcataaagccagttcttagagacctccaaaatgacttagactcccacacaataatagtggaagattttaacactccactgacaatattagacagatcattgagacagaaaattaacaaagattttcaggacctgaactcagctctggatcaagtagacctaatagatatctagagaactctccaactgaaaacaacagaatatacattcttctcatggctgcacggcacttactctaaaattgatcacattattggaaataaaacactcctcatcaaatgcaaaagaactgaaatcataacaaacagtctcccagaccacaatgcaaataaattataactcaacattaagaaactcaatcaaaatcacaagactatgtggaacttgtacaacatgctcctgaatgactcctgggtaaataataaaattacggcagaaattaggaagttctctgaaactaatgagaacaatgagacaacataccagaatctctcggatgcagcttaagcagtggtaagaggaaaagttagagcactaaatgccccatatcaaaaagctacaaatatctcaagtcaatgacctaacatcacaagtaaaagaactagaggaccaagaggaaaacttcccaaagctagcagaagacaagaaataaccaagatcagagcagaactgaatgagatagagacacacaaaatccttcaaaaaactcaagggattcaggagctgtatttttttttttttttgaataaaagttaacaaaatagaccgcatctgcactaataaagaagaaaacttaaaagaattaaatagacacagtcagaaatgataagggggatatcaccaatgaccccacaaatatacaaacaaccatcagagaatactttaaaaatctttagcacataaactagaaaatctagaagaaatggatacattcctggatgcacacaccctcccaagtctgaaccagggaaacattaaatccctgaataaaccaataataagttcaaaaattgaggcagtaataaatagcctaccaccaccaccaacaacaaaaatcccaggatcagatagacttacagctgaattctaacagagatactatttcttctgaaactattccaaatgatcgtaaaggagggactccaacatcaacaacaacaacaacgacaaaacttcaggccaatatccctgatgaatatcaaagcaaaaatcctctaaaatactgacaaaccaaatccagcaacacatcaataagtttatctatcacaatcaagatgacttcatcctcagaatacaagtttggttcaatgtacaaaaatcaataaatgttattcatcacataaacagatctaaagacaaaaaacacatgattatctcaatagatgcagaaaaggcctttcataaaattcagcatttcttcacattaaaaactctaaattaactaggcattaaaggaacatacctcaaaataataagagccatttatgataaatacacaaccaatatcatactgaatgggcaaaagctggaagcatttcccttgaaaaacagcccaaaaccacagtgccatctctcaccactcctattcaacattttattgaaagttttggtcaggtcaatcagttgtgagaaataaataaaagttattcaatcagaagagtggaagtaaaattatctttgtttgcagataacatgattctttatctagaaatcccattgtttcagtccaaaagcttcttaaactgagaagcaacttcattaatctcagaatacaaaatcaatgttcaaaaattggtagctttcctgtacaccaacaacaggcaagcaaagagccaaatagtaaataaacttccattcacaatagctaccatgaaaataaaatatctaagaattctactagcaagggaagtgaaggacttcttcaagaactacaaaccactgctcaaggaaatcagagaggacaccaacaaatggaaaaacattccttgatcatgggtaggaagaatcaatatcataaaaatggccacactgcccaaagtaatttatagattcaatgctgttctcattgaactaccattgacatgctttacagaattagaaaaaaaaaaaactattttaaaatgtataaggaactaaaaagtcagtagagccaagacaatcctaagcaaatagaataaagctggaggtatcatgctacctgacttcaaactatactacaaagctatagtaaccaaaacagcataatacttgtacaaaaacagacaggtagtccaatggagtagaacagagacctcagaaattacaccacacatctacaaccatctgatctttgacaaaccttgtaaaaacaatcagaaaagggtttactatttaatacatagctctgggagaactggctagttgtatgcagaaaattaaaactggaccacttcctaatactttatatgaaaactaactcaaggtggattaaagaattaaatgtaacaacaaaaactttaaaaaccctaaaagaaaatctaggtaataccattcaagtcttaggaacaagcaaagattttatgatgaaaacaccaaaagcaattacaacaaaagaaaaatggacaaatgggatctaattaaaggtctcctgcacagcaaaataaactatcatcagagtgaacagacaacatatagaaggagagaatatttttcccagttatgcatctgacaaagtacaatttcagttactttgctttatttgaaaatattttccctaaatcaaaatcttatcccttcctgaatatttgcaacattccttatatttctcacttttagaaagtatttatcttctaagtgcctactcctgaacttgttttgcagattgccttgtaattcaggcaagttgtattttgaaaaaaatctcaccagaaatttccatcaaagtagaattaagaaggaaaagatgcatgtgacaaaatagacaaacatgtttttattctattaatggtctgttaacctgcaatgaggtaaatctttcttaaaaggatattcaaacccagtttctgagaaaatattgcctgcagagtgtcaatattgttcaatgtttttattgtcgttgagtgcatgcattacgtgtcacccagattccccttttgggaatatagaaattactttccagctgatgaagtgatgaacaactgacatacctcacctataagctctctctctcagtacaaccctgctgaaagctatctagcatatagtgacctttccaagacagcccatatccaatgcctggtcacatgtaggactctaaaggcccattctccccttttcagtttggaccaactctgaaggcctaacagcttcagagctcccagtgggtgagacaaaagctatgctgagactgcatgtcttagcatgctcagggtgctatatagaaaaataccatacattggctagcttacagacaacaaacatttatttgtcacagttcttgaggctgaaagattcaccatcaagatgctggtattgggcattcctccaagatggcaactcgtcaccatgtcttaatgggggaaagagatgaatgagttattgtgagcatatttttcaaaagaattaattccattaatgaggactctgccttcatgacctaaacacctcctaaatggttctatcagctaatacagtaattttggttattataattataacttatgaattttgggggcattcagacattcagaccattgcactgaattatgtcctaatttgttccactgtccaatcctgcttcctactttttcacagatgttatttccaggaaaactctctaattatctccctcaaaaaatattcagcttagaatctacttcttcaaggcactgagcatttgataatatgtaccaagagaggtcagaaaaaaagaacagacaagaaaatgagattgtagagttggattattcactaccaagtgtaatgagaaccctatcactattggtacagagaacacaaatagcccctggaatgtgacaatttaaatttttcatacattcagtaatggtaaattatgatggaaatcttttgaggggaaaacattagttattaggatatatcacatatttatcaatatgggaacagtagaaattatgatcacaatacaggcaaatgtttttttccacagagttaaggcttgggagaaaataatagaagagtgaggactaataaccatcaaattaaggcaaatggtgaaagccagaaatgtctccttggaagtgttactggaaaaaggggtcttgatacagacatgaagtgaaggttcttggattccacacaggaaggaattcaaggtgagtcacagagtacagtgagaaaagatagtttattaaaagctatgacattacacagtagggcatcctcagaaggcaaggagttgaatgcaacacctttgttttaagtttttcttatatagaagtcttgtatctgtaaagattaattaagctgtatctagtcgtgggtggtcagacaacaggacaaaattgattattctatttattccaagaaaactatccttgacactttcctgtgtgaaaatatcaaaacatgactgttattatcttgaaagcatatatcgttatgaatattgggacatctggactcttcattgcagatgtgtgtgtttatagggagctgaacttaaaatcacattactctgactctcctacactcctgattccctaactgcagcatatacagagactctcacttcatgcagaagcacctggtccccatcaccaaatgaatctgaatcttaagtccaggactgaattttaaaaataagaccagttcagttctagctgaattcccagcctagtctgatcactaaccaggtttagggtctcagtttcgatacagtgaaattataagacatttgagaaataattcattgtagttaaaatcttcagtatctacactcccctgaactctgaatctgcaaaagtagtccattcctttctgttaagggatagcattttttcattgtttgaagatgatatagtgtcctcttccttgcaggacagtttatgtcccacctatgatttgtgcttggtatgatttcaattattttaagtcattcaggcttgcttcatgagaaagtttgttgttgatcttacaatatgttccatgtaaaaatgagtggaatgtatattacgtggttgtagggtggagtgttctgtagagctttaggtccaattggtcaagcatcaagtttaagtccagagtttctttgttaggtttttgcctcaataatctatctaatgctgtcaatgtggtgtcaactcctgccactattactgtatgattgggtaagtcttttcataggccaagaagtacttgttttataaatctgtctgcaccaatgttggatgagaacatattttggacaataaaaactgcttgttggattgtatcttttattattaggtaaagccattcattgtccttttaaatttttattcacttaaagtctgttttacataagaatagtaactccttctctttttcattttctgtttgcaggatagtttttactgtaccctttcatttcgaacctatggtataattacaggtaagatgggtctattgaatacaacatactcttgtgtctggcatatcagacactctatgtcttttaagtggtacgtttagcctgtgtacattcagtgagagtctctgtatatgctgcaaggatagtattaatatttgtgattttgatcctttcatggtgtgtttagctggttattatacagacatgactacgtagtttctttatagtgcctgtggactatgtgtttaagtgtgcttttgtggtagaaggggtaattcttttgaatctataagtagcatgcccttaaagacttcttacactgctggtctactagaaatatattctgtcggcatttgcttgccagagaagaatttttttttctctttccattagtaagtttagttcaggaggatacaaaattgttggttggaattccttttctttaaggacactgaaaacaggccccaagtctcttctggattataaacttccttgagaggtctgctgctagcttgatgggattaactctgtaggtgacctgctccttcttgaagactggttcttcaaatcaaccagtcatacaaaaataaagaaaaaaaaattaagaaaaataaagaaaacctctgagaaaatacaattatctaaaaagaccaaatctctgactcattgtctttcctgagagagaagtagagagaattagcaacttggagaatatatttgaggatatagtcaggtctactggggctcacttggggagaagtctggtaggacaacaggccacaccttcactgaaacaaccctgtggaggaacctacacaagcccgtgcatttgtgtgccccagctctccaagactgcagagagtgtagtctccttccttgttcaagtgatgagcatagccaccagcagtgcacttctaagctgcaggctacagccctggggcactgggaccctgtttgtagctcactgctgtggtcacttggggttggattttgggtgcagtgtaaaacctgaagggcttccaaagtgccagaatgcattcagatggagcaaagcactcaaactggcaaacagaggctgtactgtgtacaagcttctatggggcagccagagaggggccatggggttgagggttctggtgggccggtattcctgcagaacatatgtgtcacagttccatttgaaagtaggttctcctctctccccattggttagctaaggccagaacctattagaaatagatgtgcatggtatgtgggcacttatggttgggctccaccagaggtgacctatgcacaaaggtccctggctttttgtctgcagcttcatctctgtgtaatctctgggagacccctctgccagtccacatgtccctgaaggtatggagccccatctagccaggattccagatgtctacagtgagagggagctatctactagtcctttcactcaggtcttccctagaaactgttcagggcagagaatcagctgtattaaggcaccccattcagtgttctcagccttcttctgcttcagcctcagtgactattccttttctccatccacattcagcattttctctccaaagatctgttcaaattatgatgatatgataaaaaacctggtgttcccctggtggcagttgcacatcctgactgcatctagttgaccatcttgaacacatccctgtgtatatattcttttgagaattctctcttgatgtcccttgcccatttttttaatggagttgcttgtgtatggtttgtcaatttgtttaagttccttacagatttttgatattagacctttatcagatgagtagcttgcaattatattctcccattctgtaagtcatctgtttattctgttgatacttacttttgttgcacagaagctctttagttcaattatgttctattctcttgattttattctaggattttatacttttaggatactgtactagcctgttgtcatgctgttaataaagacatacctgagactggataatttataaaggaaagaggtttaatagattcacagttacacatggctggggtggcctcacaatcatgatgaaaggcaaatgagaagtaaagtcatgtattacatggaagcaggcaagggagcctgtgtagggaaactctcctttataaaactgtaagatctcaagagacttattcaccgtcatgagaatagcatgggaaagatgtgctaccatgattcaattaccactcaccaagttcttcccacaacatttgggaattatgggagctacaattcaagatgaaatttgggtgaggacacagccaagtcatatcattcttcccttggccccttccaaatatcaggtcctcacatttcaaaacaaatcatgcactcccatcagttccccaaagtcttagttgatttgagcattaactcaaaagtccacagtccaaagtctcatctgacataaggcaagtattttctgcctatgagtttaaaaatcaaaagcaagttagttactttctagatacaatgaggatacaggcattgggtaaataacactcctaaatggcagaaactggccgaaacataggggctacaggtcccatgcaagtccgaaatccaggtaaggcagtaaaatccaaggggcagtcacctccaaaatgatattctctgactccatgtctcacatacaggtcacactgatgtaagaggtaggctcccatggccttgggcagctcaacccctgtggctttgcagggtacagccctcctcttgggtgctttcatgggctggcattgagtgtctgtggcttttccagttgggtggtccaaactgtttgtggatatatcattctagggtctggaggatggtggccatcttctcccagctccactaggcagtgctctggtggggactctgtttgtgtgtgtgttggggtggggggctgcagggggttgctcacaccacacattttcctttcatactgccctagcagagtttctctgtgatggtctcatccctactgcaaacttctacctgaacatccaggcatttccatacatcttctgaaatctagacagaggttcccaagcctcaattattgatttctgtgtacccacaggctcaatcccacatcaaagctaataatctgccaaggcttgggggttgccccactgaaaccatggcttgaggtctaccttggccccttttagccacagctgggacacaggggaccgagtactgagactgcacaaagcagcaaggtgctgggcctggcctacaaaactattttttccttctaggcctcctagcctgtaatgggaaaggctgcagccaggaacacctctgacatgccatagagacatcttctccattgtcttggttattgacaattggtttctaattacttatgaaagtttctgcaacttgaatttctcctcagaaaatggggttttccttttatatcatatcaccaagctatgaattttccaaacttttatgctctgcctcccttttcaacataagttccaattccaaaccttatctttgtgaatatgtaaaacggaatgcttttgtctgtacccaagtcacctcttgaatactttgctgcttagaaatttcttccaccagatgccctaaatcatctctctcatgttaaaagtttcacaaatctctagggcaggaggaaagtgccaccaatctttgctaaaacataacacagtcacctttgccccagttaccaacaagttcgttatttccatctgagaccacctccgcctggactttattgtccatatcactatcagcattttggtgaaagcactcaacaagtctctagaaagtttcaaactttcacacatatttctgttttttcttctgagtcctctaaactgttccaacctctgcctgttacctagttccaaagttgcttccacattttctgatatctttacagcagtaccccactacctagtatcaatttactgtattagtctattcttatgctgttaataaagacatacccaaggctagttaatttataaaggaaagaggtttaatgggctcagagtttcacataaccaaggagacctcacaattatggcggaaggtgaatgaggagcaaagccacatcttacatggcagcaggtaagagaggttctataaactcccctttatagaacaattagatctcatgagacttatttactatcaccagaacaacatgtaaaagacccaccactatgattaaattacctcccactggatccctcccacaacacatgtaaattataggtgctacaattcaagatgagatttgggtggggacacagccaaagcatatcagttaaacatttacatctttaacccatcttcagttggtttttgcgtatggtaaaaagaagatatctagattcagtcttctgcatatggccagccagttatttcagcaccttttgttgaatagtgagttgtttctccattgcttgttcttattgactttgtttaaatcagatgactgtaggtgtactgctttatgtctgagttctttaactggttccattggtctatgtgtctatttttgtaccagaaccatgctgtttcagttactgtagccttgtattatagtttgaagttgggtattgtaagcctctggttttgttgtttgttcttagaactgttttaacttttgggctactttggtttcacaggaattttagaaaattttttttctaatttcattgaaaatgttcatggtagtttgatagaaatagcactgaatcagtaaagtattttgggcagtatggtctttttaacaatattaatttttctataattgagcatgaaacatatttctttttgttggtattgcttctaattttgtcaacagcattttgtaatgtttgggtagagatttctcacttccctggttagctgtatttctaggtatcttatctgtggctgttgtaaatggtagtgcattcttgatttggctgtcagattggaggttgttggtataaaaaaatgttactgatatttgtacacacattttgtctcccaaaactttgctgaagttgtttttcagaagtgggagcttttggacaggggctttagggttttcactgtataaaatgataactctgtgaagagagatagtttgtctttctctctttctatttggatgccttttatttttctcttttactctggctaggacttccaatactatactgaatagcagtagttagagtggccatcactgcctttttccagttctcaagaggaatcctttgagcttttgctcattcagtatgatgttgactgtgggttttcacagatggctcacactatttttgagtatttttatttaactcataatttgttcagggatttttaaaatgaaattgagatcaaacaatcattaaaaaacatcaacaaaactgaaagtttgttatctgaaagagtaaataagatggataaatcactagatagactaaaaaagaataaaaaagggatgatccaaataaacacaatcagaaatgacaaagagaagatcatcattgaccccaggaaaaacaaactacctgcaaagatcattatgaatatctctatgcacacaaacttaaaaacctagaagaagcagatatatttctggacacttacatcatctcaaagttgtaccaggtagaaatagaaatcctgaagtgacccaaaatgtgttccaaaattgaatcagtaatataaagtccagcaaacataaaaggcctgaatcagagagattcacagccaaattcttttatacatataaaaagaaatactagccatcctactgaagctatttcaaaaaattggagaggagggcctcctacttaactaattctatgaggccaagattgctctgataccaaaacctggcagagacacaggaagataagaaaatatcatgccaatatccatcatgaacatggacacaaaaatcctcaacaaagtactaactaatagaattcagcagcacatcaaaacctaaccaccacaatcaagtaggcattaatcctaggatgcaagattggttaaacatatgcaaataaataaatgtgattctccacatacataagactaaaaagaaatacaccacaatcatttcaatagatgcagcaaaggctttcaaaaaattcaacatcactttccttttttattttgaagcactctcaaaggaaacaatttaatacttctgctcaaacttcaggagatagtggtaacagactactactaagatatctccataatcttgggaaagactgtggctactacaaaatgaagcttgtgtgctggaactcccttgacagtgaatgaaagagggaatcagaaggcttatgacagtggatacattaacatagacatcctataccatgttggaaatctatagaatgtttgctgaagttataatgaatgttcaatatgtctaccctctgagggctaggtccttttggacttaccaaaccaatctcactgatatgatttatgatcagatattgaaataatagagaccttcagaaggcagatggtcaaaataaacaagagcactaagactggggtgttatccagaaagacctaatttatgaaagctgtgtatatagtaacagagaagatagcactaggggcaaaatagataggtgagcaagggaatttctcaatctataataccagaagagttcaagaatggatactaaaaagttgagggcagctgtcctcactagaaatcacagtaaattgtcaagggtctggacctaagtgtgttttcagacctgaaatttattgactgaagaagacaccagtggctccaggggaaaaaaaacagtaaactgtaaaaccaaggaaacttacatgctactgattccataatttttttttttttcctgaaatggagagtggcatccctaggataactgatgatttcctcagcctccaaaatgcataattttttagatccactttgtctttagaaaaccgtgaaattgtatcattggtgtctggatacaagtcattttagtggaaaaagccaagtggattctctttgcattagtttcctggcttcttaaaacagaagttattctctgttattcttatctctctaagccagaaggtcaaaatctgtgttctcagggttcatttgttctggaggctctaggagggaaacaaccaatgcctgtctcttggcctttattggttaccgacaattcttggaatcccgtggcttgtgacttctctccaacttctgtttcctcagcatcatcttttcttttctttcttactagttttatcctgcctttattcttttcaaaagaaactgtgtcttgctatattgacttggctgatcttgaactcctggcctcaagggatcctcctgcctttctccttataagaatatctgtcattggatttaaagcacatcgtaaatccagaataaacttgtcttgattttcttactttacttacatctgcaaagatcttttctccattaaattcactttaatagattctggaggttactcactgcacacatttttggcaaagacatctattcaattcactatatgcatgcaacttcttcattcctccattaccacagatgtcaggtgaccaagaaaatggaaaataatattgcattacatgcctggggattgtgaaaattaaagaccttaaaggtttaaaggatgcaggatgatgggctccattacatctttgattaaaagtctgaccactgcaaaatccaacagatcctagagtctggtagtggactcctgcaatttccaccaagtagttgctccactggcatcccctgttccagatggagtacctttgctagaccacatgaaaattcatattattaaaatgtctgtactcctgacagtgattaatagatttactgcaatctctattaaattcctatggtatttcttatagaattgaaaaaacttaaaatttatatgaaaacacaaaagactgttaatatgcaaacatgatttttttaaaaatgcacagaatgatcttatatattgcttttaagaaagcaactataagactttatagaaaaaatactttcttttataggttagaactgaatctactcagttttattcaagattaaatctgtccacttcttcttcacctcagaatgttaacgtttttataggattattcaaaagtaccttaattatgccctgttctgcatgcacaatccaggagacagtaagttcagagaattatagtccaacttgtttggactgacttttgttccaattttggggattggcttttggtcgttcatttcttctacggtcaaaatgtaagtggactcattttgatccatgtcatctctctcgaaagaaatatgctgtttccaaattttaaactgaacttagcttggaaaagaaggcctagtaacagagataggagttgtcattatatctctagctatcattatataatgaaagccagactttgtcaactcactcttttaccagaattttaaactccctaatagatgattgaagtgataacatgatttcctttaatgctgctcacagacttcccactttatttagaaaattcattattatagagcctgggtgatggataaagtaaggcattcacttgtttttcttatgttatagacagaagctgggtttcggtccataatatcaaaatgtcatctgttatttatattgacataactttctgaaaacagtgcaagtcaagatttgcagtgtttaatgaaacctgaattttgaaattttacctccttttgtgggaaataattttaagaatcagatatagagtttaaaatttaaagttctgtcggatctaggaaagattattttgctatatttgtgtttctctctgtgaaatttttgatcaccaattccaataaaaaccacaatagcattttctccagagatttcaatgaattctttgatttcctgtaaagaaataatttgtacatcaataagagaaatgcatcatataaatttcaaaaatagatgcatataattttaatagctttactgaaggaagaacaattgatatacaaaaaacctgcaagtatttttacttatatatttatattatttatatatatataaattgatgagttttgacatatacatgcacctatgatgctatcattacaacaatgaaggtaataaacatatccatcacctacaaaagctctctttgtcactctttgtttttgatagtaataatgcttaacatgagattgaccctcttaacacattattaagtgtacaataccgtgttgttaactataggcattatattgtagagcaaatttctatgcttattcataaacataagtgaaactttatacccactgaacaacagctccccatttctctctctcccaaacccctggaaatcactattttatttctgcttcaattagtttgcctattttacttaactaatataagtggaatcataaaatatttgtcctttttttattattatactttaagttctagggtacatgtgcacaacgtgcaggtttgttacatatgtatacatgtgccatgttggtgtgctgcactcattaactcatcttttacattaggtatatctcctaatgctatccctcccccttcccccaaccccacgacagaccccggtgtgtgatgttccccttcctgtgtccatgtgttcccattgttcaattcccacctatgagtgagaacatgcattgtttgtttttttgcccttgtgatagtttgctgagaatgatggtttccagcttcatccatgtccctacaaaggacatgaattcatccttttttattgctgcatagtattccgtggtgtatatgtgccacattttcttaatccagtctatcattgttggacatttgggttggttccaagcctttgctattgtgaatagtgccacaataaacataagtgtgcatgtgtctttatagtagcatgatttataatcctttgggcatatacccagtaatgtgatggctgggtcaaatggtatttctagttctagatccttgaggaaacaccacactgtcttccacaatggttgaactagtttacggtcctacaaagagtgtgaaactgttcctatttctccacattctctcccacacctgttgtttcctgactttataatgatcaccattctaaatggtgtgagatggtatctcattgtggttttgatttgcatttctctgatggccagtggtggtgagcactttttcatgtgtctgttggctgcataggtgtcttcttttgagaagtgtctgttcatatactttgcccactttttgatgggtttgtttgtttttttcttgtaaatttgtttgagttcactgtagattctggatattagccctttgtcagatgagtagattgtaaaaatcttctgccattctgtaggtttcctgttcactctgatggtagtttcttttgctgtgcagaagatcttcagtttaatgagatcccatttgtcaattttggcttttgttgccattgcttttagtcttttagacatgaagtccttgcccatgcctatgtcctgaatggtattgcctaggttttcttctatggtttttatagttttaggtctaacatgtaagtctttaacccatcttgaattaatttttgtgtaacatgtaaggaagggatccagtctcagctttctacatatggctagccagttttcccagcaccgtttattaaatagggaatcctttctccatttcttgtttttgtcaggtttgtccaagatcagatggttgtagatgtgtggtattatttctgagggctctgttctgttccattggtctatatctctgttttggtatcacaaccatgctgttttggttactgtagccttgtagtgtagtttgaagtcaggtagcatgatgcctccagctttgttctattggcttaggattgacttggctatgagggctcttttttggttccacatgaactttaaagtagttttttccaattctgtgaagaaagtcattggtagcttgatggggatggcatttaatctataaattaccttgggcagtgaaggcattttcacaatattgattcttcctatccatgagcatggaatattcttccacttgtttgtgtcctcttttatttcgttgagcattggtttgtagttctccttgaagaggtccttcacaacccttgtaagttggattcctaggtattttattctctttgaagcaattgtgaatgggagttcactcatgatttgactctctgtttgtctgttattgatgtataagaatgcctttgatttttgtacattgattttgtattctgagactttgctgatgttgcttatcaccttaaggagattttggactgaaatgttggggttttctaaatatacaatcatgtcatctgcaaacagggacaatttgacttcctcttttcctaattgaataccctttatttctttctcctgcttcattgccctggccagaatttacaacactatgttgaataggagtggtgagagagggcatccctgtcttgtgccagttttcaaagggaattcttccagtttttgcccattcagtatgatattggctgtgggtttgtcataaatagctcttattattttgagatacgtcccatcaatacctaatttattgagagtttttagcatgaagggttgttgaattttgtcaaaggccttttctgcatctattgagataatcatgtggtttttgtctttgtttctgttcatatgctggattatgtttattgatttgtgtatgttgaaccagccttgcatcccagggatgaagcccacttgatcatggtggataagctttttgatgtgctgctgtattcagtttgtcagtattttattgaggatttttccatcaatgttcctcagggatattggtctaaaattcttttttgttgttgtgtctctgcccggctttggtatcaggatgatgctggcctcataaaatgagttagggaggattccctctttttccattgattggaatagtttcagaaggaatggtaccagctccttcttgtacctctggtagaattcagctgtgaatccatctggtcctagaccttttttggttggtaggctattaattattgcctcaatttcagagcctgttatttgtccattcagggattcagtttctccctggttcagtcttgagagtgtgtatgtgtccaggaatttatccatttcttccagattttctagtttatttgcatagaggtgtttatagtattctctgatggtagtttgcatttctgtgggaacagtggtgatatcccatttatcattttttattgcatccatttgattcttacctcttttcttctttattagtcttgctagtggtctcccaattttgttgatcttttcaaaaaaccagctcctggattcgttgattttttgaaggctttcttgtgtctctatctccttcagttctgctctgatattagttatttcttgccctctgctagcttttgaatgtgtttgctcttccttccctagttcttttaattgtgatatttgggtgtcaattttagatctttcctgctttctcttgtaggcatttagtgctataaatttccctctacacactgctttgaatgtgtcccagagattctgttatgttgtttcatagttctcattggtttcaacaaacatctttatttctgccttcatttcttatttacccagtagtcattcaggagcaggttgttcagtttccatgtagttgagtggttttgagtgagtttcttaattctgagttctagtttgattgccttgtggtctgagagatagcttgttataatttctgttcttttacatttgctgaggagtgctttacttccaactatgtggccaattttggaataactgcaatgtggtgctgagaagaatgtatattctgttgatatggggtggagagttctgtagatgtctattaggtccgcttggtgcagagctaagttcaattcctggatatcctttttaactttctgtcttgttgatctgtctaatgttgacagtggggtgttaaagtctccagttattaatgtgtgggagtctaagtctctttgtaggttactcaggacttgctttatgaatctgggtgctcctgtattgggtgcatatatatttaggatagttagatcttcttgttgaattgatccctttaccattatgtgacagccttctttgtctcttttgatctttgttggtttaaagtctgttttatcagagactaggattgcaacatctgcctttttttgttttccatttgcttagtagatctttctccattcctttattttgagcctatgtgtgtttctgcacatgatatgggtctcctaaatacagcacactgatgggtcttgactatccaactagcaatttggataaaatatcttctaattggagcatttagcccattgacatttaaggttaatattgttatgtgtgaatttgatcctgtggttatgatgttagctggttattttgctcgttagttgatgcagtttctttctggcatcgatggtctttaaaatttgtcatgtttttgcactggctggtaccagttgttcctttccatgtttagtgcttctttcaggagctcttgtaagacaggactggtggccacaaaatctctcagcatttgcttgtctacaaagtgttttacttctccttgacttatgaagcttagtttggctggatatgacattctgggttgaaaattcttttctttaggaatgttgaatattggcccccactctcttccggcttatggagtttctgctgagagatccactgttagtctgatgggcttccctttgtgggtaacccgacctttctctctggctgcccttaatattttttccttcatttcaactttggtgaatctgacaattatgtgtatttgagttactcttcttgaggagtatctttgtggcattctctgtatttcgtgaatttgaatgttggcctgccttgctaggttggggaagttctcctggataatatcctgcagagtggtttccaacttggttccattctccctatcactttcaggtacaccagtcagacatagatttggtattttcacatagtcccatatttcttggaggctttgttcatttcattttactcttttttctctaaacttctcttctcgcttcatttcagtcatttgatcttcaatcactgataccctgtcttccagttgatcgaatcagctactgaagcttatgcatgtgtcacatagttctcctgccatggttttcagctccatcaggtcatttaaggacttctctacactggttattctagttagccctttgtctaatcttttttcaaggtttttagcttctttgtgataggttcaaactttctcctttagcttggagaagattgatcatctgaagccttcttctctcaactcttcaaagtcattctccatccagctttgttccattgctgatgaggagctgtgttcctttggagggggagaggcactgtgatttttataattttcaacttttctgctctgttttttccccatctttgtggttttatctacctttggtctttgtttatggtgacgtacagatgggattttggtgtgaatgtcttttctgtttgttagttttccttctaacgttcaggaccctcagcttcaggtctgttggagtttgctggaggtccactccagaccctgtttgcctgggtatcagcatcagaggctgcagaacggctaatattgctgaacagcaaatgttgctgcctgatcgttcctgtggaagctttgtctcagaggggtacctggccgtgtgaggtgtcagtctgcccctactgggggggtgcctcccagttaggctactcaggggtcagggacccacttgaggaggcagtctgtctgttctcagatctcaaactctttgatggggagaccactactctcttcaaagctgtcagacagggacagttaagtctgcagaggcttctgcttccttttgttcagctatgccctgccccccagaggtggagtctacagaggcaggcagccctcctgagctatggtaggctccaccttgttccaccttcctggccgctttgtttacctactcaagcctcagcaatggcgggcacccctcccccagcctcacagctgccttgcagttcaatctcagaatgctgtgctagcaatgagtgaggctccatgggcatgcgaccctccgaaccaggcatggaatataatctcctggtgttccatttgctaagactgttggaaaagcgcagtgttagtgtgggagtgacctgattttccaggtgccatctgttacagcttcccttggctaggaaagggaattccctgatcccttgtgcttcctgggtgaggagatgcctggacttgctttggctcacactccatgggttggttgcactcactgtcctgcacccactgtctgacaagccccagtgagatgaacccagtacctcagttggaaatgcagaaatcaaccatcttctgtgccgctcatgctgggagccatagactggagctgttcctattgggccatcttggaactgccccccatattagtccttcttgaacttgcttaattcacttagcataataccctctaggttcatccacattgtcacaaatggtaccttttgtcaaaccttggcaactgaattgacatttctactgcttccatatacagagaaattatactaactgaacttgtgaaaataatttattgatattaaattaaaatgctcatgaatagtttttgaattcttgtaagatcagatatggagaaaaatctcaaatttgtctttattttaatgaatgaaaaatatttatgattttgaaataattagcaatgggaaactaattaggaaaattgagatttttagattgttctactgttttgattattattgacataacataatatatcgtatatttctatatttactttaaaatacatgtttatatatacatatatatatatagacagagccatcgtgagtaaattagtgtgtatgtgtagtgggggtgtttgtgttttctttaatggatactctagcagcagttatctagtgtatgtcatgtactaattaatattgcatcccagaaacaaatcctaaaactgctttaaatttgtatcttttctctctcttctttctaagaaagaaatgtatatatggaacaatactctctgaatttgtttcattttagtataccacatgatagtgtggtgaaggagtgtgaggacaggcagacagagatgggagaaatggagagacagagagagaaagaaagaaagaaagagacagagaacttattatagtgaagccttatttatctttgtatcatgaggggctagctcaggacctggcatgaatggagcttataaagtgtatattaaaataaataggccacttatgacatgggttaagtcattcatattccaaatttaatgtaagaggttcgttctagcataaatatatatcttaggctttacaataaagtaaaatattgttacttttatacatatgatataggtttaattttgagagcacgcacaatatttatttaaaaatgctccttaaataaatttaaaaatatatttctacatgaatataatgtaacattaccaattttattgagtctctgtttttttcttataaaaagaacttacaatgataatacataagtaaaactgtaataattatacctactagacacataaaagctttgaattgaagaaaaattttacaataatctgtgtcaggttatgatttaaatttagaattactgtattctaaattctcaaacagagatcatcaatattttttagttatggtactgaattcaatagaactttaaatgtacatcatgtatgtgagctgacatagaggaatcatgattaagtaaatcaaaatagtattaatgttcaatgacatgtggtagagagaaatatttgatttttaagttagaatttaggcattcaaaacaggaatcacaggaataacaaaaggacataactctgaactatgcacaccagataagcataaaatttattttgcaaatgtttttgcagtttagtcctttgcatcagtttatattgtgggaaagtaagggagcaagaacagctgaaatgatataacacataaaaatatcagataatttttattgtaaacagatataagctgaatttgaaaacaaaattgataagaaattaaagaggaatatatttcccacttgttcctttcatatataatccaaagcctaaaattatgattctttatagaaatatcttcctgcttttctgtcatttgtcaaaagaagaataaaatcaatatttatttttagggctacattactgcatcatgaacctaaacttaattctgactctagaaaccaagtcaaaccatcaagaaatgtaaaccatgagcaaatgagaataaatgcaataaaatcacatccaatataaaaggcacggagatactacaaagagtaagaaacatcagaaagggtttaggtgaaaatataataaatattccttttctaaaatgttgtggtagtaatagtttattacttaatctacaaaaaatattgtcagtatttccatacttaccgaaatgagtatgatacctcagcctcactccttcagtatctttttaaatctattaccgtactacagtatcatttcaacaatgttaaatatttaatcacaatttaaatattaaatattaatgataaggataataatcctttactatgacctatactattcataccgttctggaaatataacatataataccagcagatcgcaagttagatagaccaaaaccctctcaaaaccaagaacaaacaaacaaaaaatacaaagcaaaacatttagcctctgcatttaaggcatgtttttcatcaatcctgatgtgctgccgggaatatacaaagaagaggtaagacatctgggattcccatgggaaaccagaaacgaatatataaatgaaatgttgagaagcccagccatcaattctccatagtaagctaaagggtcagcaaaacaaataaacttggctgcctacagcctgctgagtaactccttatttttatttgcctgccacaccatgaaagactctgcagttctaaagaagctttgtagagaaaagcaaagatatcttctgtgagggtttcttagtttactgaaagtaggagaaccttcacattaaaaggaatcagcatgatcaagcagaaggcttggtggaggtgctaacatggttatctcatatccatcaagttggagtttttctagaataacttttaaattgagtgactaaaattcatgggccagacaagtactttcccaaactttccagagtcaaagaaacacagattcagcaggaaaaaaaaaacaaaaccaaacacacacacacacacacacagaagacattcacagttttcatgaccaactcttcctttaatttacccttggtttaaaataagtacagcaagctcataagccagattcatcctaaatgtgtttcatgctttaatttctcagtcaattgatggtgaatgagtctggactttggacagcctacttattccaatagtcaaagtggaatatagctgtcctcatggaaaagatcatcaaattaagcaatatagcacaaattacataaaagctttctaaaataattttatataataggaatttatgcacttaaaattaaatacaacggaaaggatttctggttgagtctaagaaagttttccatgagatcttaattgttctaataagaagatttggattctcttctttagatttattggaatgttcatttggacatcttatttattttcactttgtttatcttaatgttgggataatagaaagcatagatattgagaatgcatactctactattggtattttttttgtcaaaatgtataatttattttgaaatgttaaatagtgcttatgggctgagtcatggctcattactcagaattcatttgtttgtgttctaaccccaagtacctcagaataggactacatttggagacagggccattatggaaaaaactaatataaaatgagggcatatagagaatatcttatatggacataaggacaaacacagagaaggaagtccatgtaaaaacactgaaggaaggcaaccatctacaaaccaatcataatggctttagaagaaaccaactctgttaatcacactttgattacacacttctagcctcctgaatgtgagaaagcatgttccttggagagaagcacaacacactgatcattagagaaatgcaaatcaaaaccacaatgagataccatctcacgccagtcagaatggtgattattaaaatgtcaagaaacaataaatgctggtgaggctgtagagaaataggaatgcttttacactgttggtgggaatgtaaattagagctaggtctttgagattatgttgattaattgatatccaatacaaaccaagttcaaagtagatgagtagttagagagagggtaaaaaatggagagttaaaaattaataaataataaagcagtctagatggtatacacactacttttaagggagcttttttttgaagtttagtgaaacttatgtaacttttaaaaatttcaattttatttgtaacttctgagtgattggttgtgttaaaaaagttaccatacaatttcccatcttaacaatttttaagtttgcaattcagcaatgttaaagtatatttacatttttgtgccacaggtttctagaaaatgttcatcttcgaaaacacattgaacaacataccattttccctttactccagcccctggtatccactattccactttctctttctatgggttttactacttttgacaccacatgtcagtgaaatcacttatatgtgtatttatctttttttgactggcttattcaacttgttataacatcctcaagcttcatcaatgttgtcacatacgatagaatagaattttccttttttacaagctaaaaaaatcattcatttcatttatataccatgttttctttgtccattcatccatccatggacatttgtgttgctttgctctcttgactattgtgaataatgttgcaaagaacatggatgtgcaaatatgtctttgagatcctacttttaattattttggataaatacctagaagtaacattgttgggtcatatggtaattttattttattttatttttttgaggaacctccataccttaactatacgggtgtcaccatttttcattcctaacaataatgcacaagagctcctatttatatatattatcttcaatactttttgttttctgggctgtgtgtgtgtgtgggggggggggtgtgtgtgtgtgtgaatatatgtattcaaaaatattttgaggtggctaatggttatgatgtgatagttcattgtaatttaggtttacatttctctaataattagtgatgttaagcatcttttcatatgctttttggccatatgtctatattttctgaataaatgtgtattcaagtctttgaattattttaattgaatttttgctattaaattatagggaattgtcatatattttgaatataaaacacttagctgataaattatttaccaatattttctttcttgcaacctatttctatggcatcagttgtaatgtcttctctttcttatttctttttgtttttggcttggtctttgttgtgtctccaggctgcagtgcagcagcagcaccatctcagctcactgaaaccctcacttcctgagttcaagcgattctctcatgtcagcctcctgagtagctgggactacaggtgcatgccaccacacctggctaatttttgtagttttagtagagacagggtttcaccatgttgcccagactggtctcccactcctgggctcaagcagtcagcctgcctcagcattccaaagtgctgggattacaggcataagccaccatgctcagcctgattttaattatacaactattcgctttttttaatcaagaaaacaatttcttgattttgttgatcttttcaaaaaaagaaagcaataactcagttttgctgatttttctctattttctattgtatttatttctgctgtaatctttattacttttttctttctgataattttggtcagttctttgatatgtaaagttagattgctttagatatttcttctttttaacataggcatttattactataaactattttcatagtattgtttttgctacatttgtaagttcaggttccttttttcacttctttttgtgtatcttctacagcaagcttgtccaacctgcagcctgacaggtgcatgcagcccaggacggctttgaatgtggcccagcacaaacttgtaaactttcttcaaacactgtgatttctcttacgattttttcccagctcatcagctatggctagtgttagtgtattttatgtgtgtccaagggcaattcttcttttcccaatgtggttcagggaaggcaaaagattgggcacccttgttctataggtgtattttgtggttaccaggaggattgcatgaagtattttataataaacattatataataaaacaaatttaaaaataaataaataaaatataaataaaataaaatataaaattaattttatataattataaaataattacaaattataaaaataaaatataaataaatattaaataaaataaacattttaaaataacagttcattttaaacaaaaaaccctttaattatacatgaaaagtctattcctttacatctcccattcctactttatgttagcaatatcactagttgtatattttgtgttgtgtcccaattaatataaatgtaatgttacttttatgcttttctcttttaaattgcatatcagaattaaaagaaacttgtgaagcaacattaaaaacttatgggattttatatttaattacatatttatctctaccagagaaatttatacttttacattcattcattttgctacctagtctccctcatttcaacttgaaagactcctttttgcttttctgtaggacaggtgtggtaataattaccttcttcaaccttttttaaacccgagaaaatattcaattttccattatttctgaatgacaggtttgccaaatgaatgtcttgtgtggtaggttttttttttcttttctgatttttctttcaacactttgaatatgttacatcacttacttttggtttaaaaagatgtctgctggtatcttgttgataataccatgtgagttcccttttatgtcatgattcatttttcttctgcttccgagattctttctttgtgacttttgaaagtttgattatgatatttattgatgcaaaatttttgaattgatctcagtgtacggtagttgtattttaaaacaattctatgtccatattcttcctcaaatttgggaattgtctgcctgccattatttctttaaatagactttttatctcaatcttttcctcttgtcccatgagggctctcataatgcataactggtcaggttaacaatgtcccataagcctccggctttcttcattttattatgagattcttcttgctcctctcccttaatagcttgaaatggccaatatttcaaattcatgaattatttttttctagctgaacaagtcatctattgaatttctctagtaaatttttcaatttagttattgtattatttacctccagaatatctatgtggttgttttctataatttttgtgtctttgttgatacttttatttcatatatgtattattttcctgatttttaaaaacttgtctatgttcttttagttaatcgagcatctttaattatttttgaaatttttgataggtatttaagatattttgaattttttgacaggtaatggatagatctttgttcattcaggattgaaaaaaggtttactttgttcctttaaacaggtcatgctttccaatgtctgcatgttttgcatttctttgtttaaattttgagatttaaagaaacacccacatctcccagtctttatgtactggcttagtgtagggaaataccttcatctatcacccctcctagagattctgggagttttgtgaaccattccaagagctgtagcctctccaggcttttgaatgtaattactaagttaaatccagtttttgtttgtttgtttgtttgttttcaggattttgtaatattttacttcacctgttgtcattctgtagtaataatgcagctcttctggtactgccctaaactgccccactgcctttattcccaggcattcaaatgctggggtttctataggtgatttaagctcagtgacagaaatcagacccttgggaagtctctaaggagccagaacattagaccacatttcaattagagcactagaatattctgaatttgtctatatatttacatttaccagtgactttttatatttttatttgttacatgttagtgtccttttcctttagagtgaaaaataccctttgcatttcttcttaaacaggtttcgtgttggtgaattctcctagttttatttgtcttgaaaagtctttatctcttcctcatatatgaagaagtgctttgatgagtacagtatttttggattaaaggtttttcaaatttttgattacttcagcatttggctatattatcccactctcttcttgcctgcaagtttgcttttttttctttctttctttttttttgttttcactgaaaattcactgaaaaccatttggtaacactattgaatgtgttatgttttgttgttgttgttttgttttgtttttctatctctcctgctgctttcagtattgtttttgttctttgatttttggtaatttgattataatgtgctttgggaattactttctgcgttgaatttgtctggtgttgtccaagctaactgttcccagatattattgtctttctccaaatttggaaaacattgagttattatattgagtttgttttctagtcctttcttttctcatatcctctagaaacttaaattatgtggaggtagttcccttcatagtgtcataaaatttctgtggccgccattctttctttttacttttatccctctgattgggtaattacatgttttctttctttgagcttactgattctttcctgtttgatcaagtctactgttaaagttttctaatgagtttttcagtttaacaattttatcctgcatttcaaggatttcatttttttattattttgatttctttctgaaatgtctaatattgtgtctgcattattttccaagtttcttttagttttttgattatggtttatgtgattcctgaacttttcaaagagatttattttgaatttgttgtcagatatttaagcatcttcgaatctttttgtgcattattgaaacttgattggtttcttttggagatgtcatatttccctgttttttttttttttttttaacaatacttgctgtttacattgatgcctgcatatttaagaagatggccacttgattcagctttttaatgtgttatgcagtggtgttaaaatattactgcttaataccagagctgaatcactaccctgagcattctttctgttctgaggatggcttatatttgatagcagaacctaaatagtgcattagagctaaatctcttccatgctgttgttttcctgtctggggaagacttatcatgaccatgaaaacacaatgctgcaccagaacttaaacccaaagccgtaataatttccgggttggggaaggcttaagaaataactagaacttagttacttacctgatagttgtttctgggtcagagaaaggctctgtatgatcacctgggttatttgtaaaatctgaccaaagattctagccttcccctggattgtgcctcctgtactactgtagtgctggctagcccccccatcaatgtgaattccctgttgataggaacacaaagcgtctgccaagatctgtttgccatttgctgtgattagtgcttctgctctttgcttccaattcaacccaggtggttcagtccttctgacactcctaatacctcctgtgggatggaaaaaagaagatttctcacaatgattcacaccctgacatggggactgagcgtccacctgcaattattttcttccacctgggtaattgcaggtacagggaagttttctgtgagtggtgctattttggtttggagaatgggttgatgcagcacaaatgacctttcttctttctggtcatggattttttaatttccatgaaccaataagatttttcacctttctcctgagctccggtgcattcagagtggtatttttatatttgaatagttgctagttgtacttttaagatggattgatgctagaggtcttcagttccaccatcttgctgatgtcactactcaaaaatatttttacatgttaggaaattattttgtttttaggattttgtgtctacgtgacacagacatgaaaagagatgtactcttatcactgaaacttttcgtatactgttttggttgtgtgcattttctagtcatgaatgattatttatttaagccatatgttttacacatagactttcttaaaaagagactagatggttctatgtgtcagaatatagagacagaatataactacacactaataatttctcaactctttattttagaagtgtaaataacctttattttaatatttttcatattacacctctgtaatgcagagaaatttttatcttcaggaaatggaaaattttgtccagagttcatgggaagatggtattgtggtgctttctctggggtcactgtttcaaaatgttacagaggaaaaggttaatatcattgcttcagcccttgcccagatcccacagaaggtcagtaaaacctccaatcctgataagtagctattcacataatgagaaagtatagcttttgcctactgatccttgctgttactggaaacaacactcttgattgtggtttgtttataataaaatagaaataataaattaagcccctacatcttattttacaatttgaaatctaaaggcatgtgccaactgttccaaaataagttctgacatttattatttccaaggaccagaaaaaagaaaactgataaaaaaaagataaagaagaatcagtctcaatctcaagaatatccttctcatatttgagtgcataaaaactgtattcatggtacttttgcatagaaataaaagctcagcttaatgtaatctttctcaataattagagtttttaagagttaaatgtcaattgcaattatattatagtaacttaattatttaagtaatgtaattatttataatactcaactgattttaactttgttactactataattccagaatttcacactttagatagtgctatatataaactatccaaaagatattttactttctatttagctaaaatacatcaaactcaataaaggcaagtacactaattaggaatgtgaaatcttgtaattttaattacaaaattatctgttaagtagtttgaaaaatctgtgccatcatttcttttcaaatgtatgacattttttataggtttcccacaattaaaaattattgaaaacaggtacaatcccaaagaaaatttatcattgaacaacggaacataagtaattctctagcttatacttcttcaataaaacagttaaatataagaaagcagaggtcagaaagaaaatagagaagaaaagacaactgattatccaaaacacacacaaaattgaaagcaaattttatctgcggggaatggtaaatttgatggtagaagtagaatagttccatggtttaaaatgacatagggatcatgtacttataaaatttttaattcttattagaaaattgagtagccagtgctgaattactttttaattattcactgatattctcattttcagatatttttgattgataataaaataataattgtatacttaataggcaacaagtacacattatctgaaaagacctttgtaaaatgtcctactatatcttttagtgtttacacagtacgtctacatacccctgtctcaaccatcacctgaagtacaatgagtgtataatttataactatatctacatacttagaatgctaatgtcctgtagttcaatctgtgaagtacatgtgtttcttccataggtgttatggaggtacaaaggaaaaaaaaccatccacattaggaaccagcactaagctgtatgattggataccccagactgaccttcttggtaggcctatgagaaagtaaaaatatgaactagatgaggaaaaatgaataaatgttaaacagtgagcaaattcagcaaatatttaaaattataaaactttattttacttatacttttgaagcagatataattaaaggattgactaaaattgtatagatagactcacactttctattgttaagatgagagtgacaggaaattcaggaggaattaatgcctctttttctgaagatagaaatgatctttactagcaatgctccatgtgctcaccttctaaagaaaatgctgtacgcttcagtgagttatctcataattcccatctttggtgctgaaattattttaaaaattcataataaaatatctcaccatttctcattcaatttgcatacaaggtcaccccaaaccaaagcttttatcactcatggtggaatgaatgggatctatgaagctatttaccatgacgtccctatggtgggagttcccatatttggtgatcagcttgataacatagctcacaggaaggccaaaggagcagctgtagaaattaacttcaaaactatcacaagcgaagatttactcagtgtttgagaacagccattaacaattcctcgtaagtactactgattgtaaagactgatctaacattgattatgttatacattatgccaggaaatgttaaatataatcctggtagacattttaagggattttcctccgcaatattaagtcattaatcaccttggtattggaatagtcctggatattatagttcatagtgtgtcaatcttcatggaaatattaggtttaagttaacaactggcttactaaacttttattcacctctttgttttaccccattttgttaagaatatactctttttcagtctccccactatatctgtttaatgctatgcaaccaataatgttcacgtcacaaccagcatcaatcttttacccaacaaatttttagcttgcataacatatactacagtttatctacctgtcttttatgaaaacaaaactacaactttctaatttctatgtgtgtttttgccttccagttacaaggaggatgctatgagattatcaagaattcacca
